US011225523B2

(12) United States Patent
Liang et al.

(10) Patent No.: US 11,225,523 B2
(45) Date of Patent: *Jan. 18, 2022

(54) TRIPLE COMBINATION ANTIBODY THERAPIES

(71) Applicant: Compugen Ltd., Holon (IL)

(72) Inventors: Spencer Liang, Belmont, CA (US); Ling Leung, Foster City, CA (US); Sarah Whelan, Mountain View, CA (US); Maya Kotturi, Belmont, CA (US); Eran Ophir, Yehuda (IL); Arthur Machlenkin, Givaat Brener (IL); Zoya Alteber, Nes Ziyona (IL); Meir Azulay, Givatayim (IL); Sandeep Kumar, San Bruno, CA (US); Radhika Desai, Brisbane, CA (US); Christopher Chan, South San Francisco, CA (US); Kathryn Logronio, Pleasanton, CA (US)

(73) Assignee: Compugen Ltd., Holon (IL)

( * ) Notice: Subject to any disclaimer, the term of this patent is extended or adjusted under 35 U.S.C. 154(b) by 505 days.

This patent is subject to a terminal disclaimer.

(21) Appl. No.: 15/996,369

(22) Filed: Jun. 1, 2018

(65) Prior Publication Data

US 2019/0010246 A1 Jan. 10, 2019

Related U.S. Application Data

(60) Provisional application No. 62/513,960, filed on Jun. 1, 2017, provisional application No. 62/515,452, filed on Jun. 5, 2017, provisional application No. 62/538,563, filed on Jul. 28, 2017, provisional application No. 62/547,051, filed on Aug. 17, 2017, provisional application No. 62/582,756, filed on Nov. 7, 2017, provisional application No. 62/618,005, filed on Jan. 16, 2018.

(51) Int. Cl.

| C07K 16/28 | (2006.01) |
|---|---|
| A61K 39/395 | (2006.01) |
| C07K 16/30 | (2006.01) |
| A61P 35/00 | (2006.01) |
| A61K 38/17 | (2006.01) |
| C07K 16/24 | (2006.01) |
| C07K 16/42 | (2006.01) |
| G01N 33/574 | (2006.01) |

(52) U.S. Cl.
CPC ........ *C07K 16/3061* (2013.01); *A61K 39/395* (2013.01); *A61P 35/00* (2018.01); *C07K 16/28* (2013.01); *C07K 16/2803* (2013.01); *A61K 38/1709* (2013.01); *A61K 2300/00* (2013.01); *C07K 16/24* (2013.01); *C07K 16/2875* (2013.01); *C07K 16/4283* (2013.01); *G01N 33/57484* (2013.01)

(58) Field of Classification Search
CPC ...... C07K 16/3061; C07K 16/28; A61P 35/00
See application file for complete search history.

(56) References Cited

U.S. PATENT DOCUMENTS

| 5,661,016 A | 8/1997 | Lonberg |
|---|---|---|
| 6,960,343 B2 | 11/2005 | Medzhitov et al. |
| 7,622,265 B2 | 11/2009 | Fan et al. |
| 8,431,530 B2 | 4/2013 | Baldwin et al. |
| 9,499,596 B2 | 11/2016 | Clark et al. |
| 9,695,238 B2 | 7/2017 | Gao et al. |
| RE46,534 E | 9/2017 | Baldwin et al. |
| 2004/0121370 A1 | 6/2004 | Baldwin et al. |
| 2007/0037206 A1 | 2/2007 | Rosen et al. |
| 2007/0054360 A1 | 3/2007 | Gao et al. |
| 2007/0243584 A1 | 10/2007 | West |
| 2009/0181024 A1 | 7/2009 | Baldwin et al. |
| 2009/0186422 A1 | 7/2009 | Hogan et al. |
| 2009/0258013 A1 | 10/2009 | Clark et al. |
| 2009/0318376 A1 | 12/2009 | Chung et al. |
| 2011/0236903 A1 | 9/2011 | McClellan et al. |
| 2012/0082659 A1 | 4/2012 | Land et al. |
| 2014/0056890 A1 | 2/2014 | Gurney et al. |
| 2015/0210769 A1* | 7/2015 | Freeman ............. A61P 11/00 424/136.1 |
| 2015/0216970 A1 | 8/2015 | Grogan et al. |
| 2016/0176963 A1* | 6/2016 | Maurer ............... A61P 35/00 424/139.1 |
| 2016/0355589 A1 | 12/2016 | Williams et al. |
| 2016/0376365 A1 | 12/2016 | Gurney et al. |
| 2017/0088613 A1 | 3/2017 | Grogan et al. |
| 2017/0145093 A1 | 5/2017 | Clark et al. |
| 2017/0198042 A1 | 7/2017 | Williams et al. |
| 2017/0240613 A1 | 8/2017 | Zhu et al. |

FOREIGN PATENT DOCUMENTS

| CN | 103073644 A | 5/2013 |
|---|---|---|
| EP | 2 067 791 | 6/2009 |
| EP | 3208612 | 8/2017 |

(Continued)

OTHER PUBLICATIONS

Gene ID: PVRIG antibody—middle region, Rabbit Polyclonal Antibody Catalog #AI13083, retrieved from the internet: URL: http://www.funakoshi.co.jp/data/datasheet/ABG/AI13083.pdf.
Stanietsky et al., The interaction of TIGIT with PVR and PVRL2 inhibits human NK cell cytotoxicity., Proc Natl Acad Sci U S A. Oct. 20, 2009;106(42):17858-63.
Yu et al., The surface protein TIGIT suppresses T cell activation by promoting the generation of mature immunoregulatory dendritic cells., Nat Immunol. Jan. 2009;10(1):48-57.

(Continued)

Primary Examiner — Mark Halvorson

(57) ABSTRACT

The present invention is directed to triple combination therapies with anti-TIGIT antibodies, anti-PVRIG antibodies, and checkpoint inhibitors, including anti-PD-1 or anti-PD-L1 antibodies.

11 Claims, 264 Drawing Sheets

Specification includes a Sequence Listing.

(56) References Cited

FOREIGN PATENT DOCUMENTS

| WO | WO1994013804 | 6/1994 |
|---|---|---|
| WO | WO 2000/052151 | 9/2000 |
| WO | WO 2003/023013 | 3/2003 |
| WO | WO 2004/024068 | 3/2004 |
| WO | WO 2004/024068 A2 | 3/2004 |
| WO | WO 2004/030615 | 4/2004 |
| WO | WO 2004/058805 | 7/2004 |
| WO | WO2004091658 | 10/2004 |
| WO | WO 2005/016962 | 2/2005 |
| WO | WO 2005/019258 | 3/2005 |
| WO | WO 2006/124667 | 11/2006 |
| WO | WO 2006/124667 A2 | 11/2006 |
| WO | WO 2007/121364 | 10/2007 |
| WO | WO 2007/121364 A2 | 10/2007 |
| WO | WO 2007/124283 | 11/2007 |
| WO | WO 2008/021290 | 2/2008 |
| WO | WO 2009/017679 | 2/2009 |
| WO | WO 2009/126688 | 10/2009 |
| WO | WO 2011/109637 | 9/2011 |
| WO | WO 2012/031008 | 3/2012 |
| WO | WO 2012/129488 | 9/2012 |
| WO | WO 2012/156515 | 11/2012 |
| WO | WO 2012/178128 | 12/2012 |
| WO | WO 2013/184912 | 12/2013 |
| WO | WO 2015/009856 | 1/2015 |
| WO | WO 2016/028656 | 2/2016 |
| WO | WO 2016/081746 | 5/2016 |
| WO | WO 2016/081746 A2 | 5/2016 |
| WO | WO 2016/106302 | 6/2016 |
| WO | WO 2016/134333 | 8/2016 |
| WO | WO 2016/134335 | 8/2016 |
| WO | WO 2016/191643 | 12/2016 |
| WO | WO 2016/191643 A2 | 12/2016 |
| WO | WO 2016/196389 | 12/2016 |
| WO | WO 2016/196389 A1 | 12/2016 |
| WO | WO 2017/041004 | 3/2017 |
| WO | WO 2017/053748 | 3/2017 |
| WO | WO 2017/053748 A2 | 3/2017 |
| WO | WO 2017/059095 | 4/2017 |
| WO | WO 2017/021526 | 9/2017 |
| WO | WO 2018/017864 | 1/2018 |
| WO | WO2018033798 | 2/2018 |

OTHER PUBLICATIONS

Zhu et al., Identification of CD112R as a novel checkpoint for human T cells., J Exp Med. Feb. 8, 2016;213(2):167-76.
Rotman et al., Identification of novel immune checkpoints as targets for cancer immunotherapy., J Immunother Cancer. 2013; 1(Suppl 1): P135.
Johnston et al., The immunoreceptor TIGIT regulates antitumor and antiviral CD8(+) T cell effector function., Cancer Cell. Dec. 8, 2014;26(6):923-37.
Orentas et al., Bioinformatic description of immunotherapy targets for pediatric T-cell leukemia and the impact of normal gene sets used for comparison., Front Oncol. Jun. 10, 2014;4:134.
Quinones et al., 2205 High-throughput cellular assays using a well-less plate format. Genentech, South San Francisco, CA, Curiox Biosystems, Singapore, New Technologies and Frontiers, Dec. 6, 2011.
He et al., Remarkably similar CTLA-4 binding properties of therapeutic ipilimumab and tremelimumab antibodies., Oncotarget. May 19, 2017;8(40):67129-67139. doi: 10.18632/oncotarget.18004. eCollection Sep. 15, 2017.
Scott et al., Antibody therapy of cancer., 2012, Nature Reviews, vol. 12: 278-287.
Weiner et al., Antibody-based immunotherapy of cancer., Cell. Mar. 16, 2012; 148(6):1081-4. doi: 10.1016/j.cell.2012.02.034.
Nosanchuk JD., The interdependence of antibody C and V regions on specificity and affinity: significant implications for the engineering of therapeutic antibodies., Virulence. Aug. 15, 2013;4(6):439-40. doi: 10.4161/viru.26153.
Janda et al., Ig Constant Region Effects on Variable Region Structure and Function., Front Microbiol. Feb. 4, 2016;7:22. doi: 10.3389/fmicb.2016.00022. eCollection 2016.
Levy et al., Abstract 581: Discovery and development of COM701, a therapeutic antibody targeting the novel immune checkpoint PVRIG., Cancer Research, 1 Apr. 1, 2017 (Apr. 1, 2017), p. 581, XP055506734.
Pennock et al., "The Evolving Role of Inmune Checkpoint Inhibitors in Cancer Treatment.", The Oncologist, Jun. 11, 2015 (Jun. 11, 2015), pp. 812-882, XP055320470.
Eran et al., "Discovery and Development of COM701, a Therapeutic Antibody Targeting the Novel Inmune Checkpoint PVRIG.", POS, Jun. 4, 2017 (Jun. 3, 2017), p. 169, XP055506726.
U.S. Appl. No. 16/748,695, filed Jan. 21, 2020.
U.S. Appl. No. 15/048,975, Publication No. 2017-0088607, filed Feb. 19, 2016, Published Mar. 30, 2017.
U.S. Appl. No. 16/775,133, filed Jan. 28, 2020.
Liang et al., "Discovery of COM701, a therapeutic antibody targeting the novel imnune checkpoint PVRIG, for the treatment of cancer", Journal of Clinical Oncology, American Society of Clinical Oncology, US, vol. 35, No. 15 suppl May 20, 2017 (May 20, 2017), p. 3074.
Anonymous: "Medimnune to Develop Compugen Imnuno-Oncology Antibodies", Genetic Engineering and Biotechnology News, Apr. 2, 2018 (Apr. 2, 2018), XP055605563, Retrieved from the Internet: URL:https://www.genengnews.com/topics/drug-discovery/medimmune-to-develop-compugen-i mnuno-oncology-antibodies/ [retrieved on Jul. 15, 2019].
Vajdos et al., 2002, Comprehensive Functional Maps of the Antigen-binding Site of an Anti-ErbB2 Antibody Obtained with Shotgun Scanning Mutagenesis, J. Mol. Biol. vol. 320: 415-428.
Chen et al., 1992, Generation and analysis of random point mutations in an antibody CDR2 sequence: many mutated antibodies lose their ability to bind antigen., J. Exp. Med. vol. 176:855-866.
Alvarez M., et al., Increased Antitumor Effects Using IL-2 with Anti-TGF-Pβ Reveals Competition between Mouse NK and CD8 T Cells. J Immunol 2014; 193:1709-1716; Prepublished online Jul. 7, 2014.
Scanlan et al : 11 Gl ycoprotein 1-47 A34, a novel t arget for antibody-based cancer inrnunotherapy, Cancer Immunity, Academy of Cancer Immunology, CH, vol. 6, Jan. 1, 2006.
R&d Systems: 11 Human VSIGI Antibody, Catalog No. MAB4818 R&D Systems Catalog, Oct. 13, 2015 (Oct. 13, 2015), pp. 1-2.
Chen Y et al: Decreased expression of V-set and immunoglobulin domain containing 1 (VSIGI) is associated with poor prognosis in primary gastric cancer, Journal of Surgical Oncology, New York, NY, US, vol. 106 , No. 3, Sep. 1, 2012 (Sep. 1, 2012), pp. 286-293, XP002759705.
Kim et al: 11 Extracellular domain of V-set and immunoglobulin domain containing 1 (VSIGI) interacts with sertoli cell membrane protein, while its PDZ-binding motif forms a complex with Z0-1, Molecules and Cells, vol. 30, No. 5, Oct. 14, 2010 (Oct. 14, 2010), pp. 443-448, XP055344846.
Oidovsambuu et al. (2011) Adhesion Protein VSIGI Is Required for the Proper Differentiation of Glandular Gastric Epithelia. PLoS ONE 6(10): e25908. doi:10.1371/journal.pone.0025908.
Wilson et al., Comparative analysis of the paired immunoglobulin-like receptor (PILR) locus in six mammalian genomes: duplication, conversion, and the birth of new genes. Physiol Genomics. 2006;27(3):201-218. doi:10.1152/physiolgenomics.00284.2005.
Kim et al., Gastric-type expression signature in serrated pathway-associated colorectal tumors., Human Pathology vol. 46, Issue 5, May 2015, pp. 643-656.
Tomlinson et al., Methods for generating multivalent and bispecific antibody fragments., 2000, Methods Enzymol. 326:461-479.
Shaffer, A. "Novel Immune Checkpoint Identified as Promising Target for Blockade Strategies", Targeted Oncology, Nov. 1, 2016. Found on Sep. 7, 2021, https://www.targetedanc.com/view/novel-immune-checkpoint-identified-as-promisng-target-for-blockade-strategies.

* cited by examiner

Figure 1A

Human IgG1 constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 1)

Human IgG1 D265A constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVV[A]VSHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 2)

Human IgG1 N297A constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD
KKVEPKSCDKTHTCPPCPAPELLGGPSVFLFPPKPKDTLMISRTPEVTCVVVDVSHEDPEVKFNWYVDGVEVHNAKTKPREEQY[A]STYRVVSV
LTVLHQDWLNGKEYKCKVSNKALPAPIEKTISKAKGQPREPQVYTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK (SEQ ID NO: 3)

Human IgG2 constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVD
KTVERKCCVECPPCPAPPVAGPSVFLFPPKPKDTLMISRTPEVTCVVVDVSHEDPEVQFNWYVDGVEVHNAKTKPREEQFNSTFRVVSVLTVV
HQDWLNGKEYKCKVSNKGLPAPIEKTISKTKGQPREPQVYTLPPSREEMTKNQVSLTCLVKGFYPSDIAVEWESNGQPENNYKTTPPMLDSDG
SFFLYSKLTVDKSRWQQGNVFSCSVMHEALHNRFTQKSLSLSPGK (SEQ ID NO: 4)

Human IgG3 constant region
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVD
KRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCV
VVDVSHEDPEVQFKWYVDGVEVHNAKTKPREEQYNSTFRVVSVLTVLHQDWLNGKEYKCKVSNKALPAPIEKTISKTKGQPREPQVTLPPS
REEMTKNQVSLTCLVKGFYPSDIAVEWESSSGQPENNYNTTPPMLDSGSFFLYSKLTVDKSRWQQGNIFSCSVMHEALHNRFTQKSLSLSPGK
(SEQ ID NO: 5)

Figure 1B

Human IgG4 constant region (Wild Type)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDK
RVESKYGPPCPSCPAPEFLGGPSVFLFPPKPKDTLMISRTPEVTCVVVDVSQEDPEVQFNWYVDGVEVHNAKTKPREEQFNSTYRVVSVLTVLH
QDWLNGKEYKCKVSNKGLPSSIEKTISKAKGQPREPQVYTLPPSQEEMTKNQVSLTCLVKGFYPSDIAVEWESNGQPENNYKTTPPVLDSDGSF
FLYSRLTVDKSRWQEGNVFSCSVMHEALHNHYTQKSLSLSPGK (SEQ ID NO: 6)

Human IgG4 constant region (S241P hinge mutant)
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDK
RVESKYGPPCPPCPAPEFLGGPSVFLFPPKPKDTLMISRTPEVTCVVVDVSQEDPEVQFNWYVDGVEVHNAKTKPREEQFNSTYRVVSVLTVLH
QDWLNGKEYKCKVSNKGLPSSIEKTISKAKGQPREPQVYTLPPSQEEMTKNQVSLTCLVKGFYPSDIAVEWESNGQPENNYKTTPPVLDSDGSF
FLYSRLTVDKSRWQEGNVFSCSVMHEALHNHYTQKSLSLSPGK (SEQ ID NO: 7)

Human kappa light chain
RTVAAPSVFIFPPSDEQLKSGTASVVCLLNNFYPREAKVQWKVDNALQSGNSQESVTEQDSKDSTYSLSSTLTLSKADYEKHKVYACEVTHQGL
SSPVTKSFNRGEC (SEQ ID NO: 8)

Human lambda light chain
GQPKAAPSVTLFPPSSEELQANKATLVCLISDFYPGAVTVAWKADSSPVKAGVETTTPSKQSNNKYAASSYLSLTPEQWKSHRSYSCQVTHEGS
TVEKTVAPTECS (SEQ ID NO: 9)

Figure 2

Human TIGIT extra-cellular domain

MMTGTIETTGNISAEKGGSIILQCHLSSTTAQVTQVNWEQQDQLLAICNADLGWHISPSFKDRVAPGPGLGLTLQSLTVNDTGEYFCIYHTYPD
GTYTGRIFLEVLESSVAEHGARFQIP (SEQ ID NO: 10)

Cynomolgus macaque TIGIT extra-cellular domain

MMTGTIETTGNISAKKGGSVILQCHLSSTMAQVTQVNWEQHDHSLLAIRNAELGWHIYPAFKDRVAPGPGLGLTLQSLTMNDTGEYFCTYHT
YPDGTYRGRIFLEVLESSVAEHSARFQIP (SEQ ID NO: 11)

Human PVRIG extra-cellular domain

TPEVWVQVRMEATELSSFTIRCGFLCSGSISLVTVSWGGPNGAGGTTLAVLHPERGIRQWAPARQARWETQSSISLILEGSGASSPCANTTFCCK
FASFPEGSWEACGSLPPSSDPGLSAPPTPAPILRAD (SEQ ID NO: 12)

Cynomolgus macaque PVRIG extra-cellular domain

TPEVWVQVQMEATELSSFTVHCGFLGPGSISLVTVSWGGPDGAGGTKLAVLHPELGTRQWAPARQARWETQSSISLALEDSGASSPFANTTFC
CKFASFPEGSWESCGSLPPSSDPGLSAPPTPVPILRAD (SEQ ID NO: 13)

Human PD-1 extra-cellular domain

PGWFLDSPDRPWNPPTFSPALLVVTEGDNATFTCSFSNTSESFVLNWYRMSPSNQTDKLAAFPEDRSQPGQDCRFRVTQLPNGRDFHMSVVR
ARRNDSGTYLCGAISLAPKAQIKESLRAELRVTERRAEVPTAHPSPSRPAGQFQTLV (SEQ ID NO: 14)

Cynomolgus PD-1 extra-cellular domain

PGWFLESPDRPWNAPTFSPALLLVTEGDNATFTCSFSNASESFVLNWYRMSPSNQTDKLAAFPEDRSQPGQDCRFRVTRLPNGRDFHMSVVR
ARRNDSGTYLCGAISLAPKAQIKESLRAELRVTERRAEVPTAHPSPSRPAGQFQALV (SEQ ID NO: 15)

Figure 3A: CPA.9.018

| What | sequence | SEQ ID NO: |
|---|---|---|
| Variable heavy (vh) domain | QVQLVESGGGLVQPGGSLRLSCAASGFTFSSYGMHWVRQAPGKGLEWVAFIRYDGSNKYYADSVKGRFTISRDNSKNTLYLQMNSLRAEDTAVYYCAKEMLVQDYYYMDVWGQGTTVTVSS | 16 |
| vhCDR1 | GFTFSSYG | 17 |
| vhCDR2 | IRYDGSNK | 18 |
| vhCDR3 | AKEMLVQDYYYMDV | 19 |
| Full length HC (IgG4(S241P); CPA.9.018.H4(S241P)) | QVQLVESGGGLVQPGGSLRLSCAASGFTFSSYGMHWVRQAPGKGLEWVAFIRYDGSNKYYADSVKGRFTISRDNSKNTLYLQMNSLRAEDTAVYYCAKEMLVQDYYYMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 20 |
| Variable light (vl) domain | DVVMTQSPLSLPVSPGEPASISCRSSQNLLHRNGINYLNWYLQKPGQSPQLLIYWGSNRASGVPDRFSGSGSGTDFTLKISRVEAEDVGVYYCMQGLQIPPTFGQGTKVDIKR | 21 |
| vlCDR1 | QNLLHRNGINY | 22 |
| vlCDR2 | WGS | 23 |
| vlCDR3 | MQGLQIPPT | 24 |
| Full length light chain ((CPA.9.018.H4(S241P)) | DVVMTQSPLSLPVSPGEPASISCRSSQNLLHRNGINYLNWYLQKPGQSPQLLIYWGSNRASGVPDRFSGSGSGTDFTLKISRVEAEDVGVYYCMQGLQIPPTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 25 |

Figure 3B : CPA.9.027

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSS | 26 |
| vhCDR1 | GFTFSSYA | 27 |
| vhCDR2 | ISYDGSNK | 28 |
| vhCDR3 | ARDPLPLHYYGMDV | 29 |
| Full length HC (IgG4(S241P); CPA.9.027.H4(S241P)) | EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLPGK | 30 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLSSLQLGGGTQLAVLG | 31 |
| vlCDR1 | SSNMGRRP | 32 |
| vlCDR2 | SQN | 33 |
| vlCDR3 | AVWDDSLSSLQ | 34 |
| Full length light chain (CPA.9.027.H4(S241P)) | QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLSSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 35 |

Figure 3C: CPA.9.049

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSS | 36 |
| vhCDR1 | GFTFSSYA | 37 |
| vhCDR2 | ISYDGSNK | 38 |
| vhCDR3 | ARDPLPLHYYGMDV | 39 |
| Full length HC (IgG4(S241P); CPA.9.049.H4(S241P)) | EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 40 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLFSLLGGGTQLAVLG | 41 |
| vlCDR1 | SSNMGRRP | 42 |
| vlCDR2 | SQN | 43 |
| vlCDR3 | AVWDDSLFSLL | 44 |
| Full length light chain (CPA.9.049.H4(S241P)) | QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLFSLLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 45 |

Figure 3D: CPA.9.057

| What | sequence | SEQ ID NO: |
|---|---|---|
| Variable heavy (vh) domain | QVQLQESGPGLVKPSETLSLTCTVSGGSISSSSYYWGWIRQPPGKGLEWIGSIYYSGSTYYNPSLKSRVTISVDTSKNQFSLKLS SVTAADTAVYYCARQGAAAGNPFDIWGQGTMVTVSS | 46 |
| vhCDR1 | GGSISSSSYY | 47 |
| vhCDR2 | IYYSGST | 48 |
| vhCDR3 | ARQGAAAGNPFDI | 49 |
| Full length HC (IgG4(S241P); CPA.9.057.H4(S241P)) | QVQLQESGPGLVKPSETLSLTCTVSGGSISSSSYYWGWIRQPPGKGLEWIGSIYYSGSTYYNPSLKSRVTISVDTSKNQFSLKLS SVTAADTAVYYCARQGAAAGNPFDIWGQGTMVTVSSASTKGPSVFPLAPCSRSTSESTAALGCLVKDYFPEPVTVSWNSGA LTSGVHTFPAVLQSSGLYSLSSVVTVPSSSLGTKTYTCNVDHKPSNTKVDKRVESKYGPPCPPCPAPEFLGGPSVFLFPPKPKDT LMISRTPEVTCVVVDVSQEDPEVQFNWYVDGVEVHNAKTKPREEQFNSTYRVVSVLTVLHQDWLNGKEYKCKVSNKGLPS SIEKTISKAKGQPREPQVYTLPPSQEEMTKNQVSLTCLVKGFYPSDIAVEWESNGQPENNYKTTPPVLDSDGSFFLYSRLTVDK SRWQEGNVFSCSVMHEALHNHYTQKSLSLSPGK | 50 |
| Variable light (vl) domain | QSVLTQPPSVSGTPGQRVTISCSGSSSNIGSNFVYWHQQLTGTAPKLLIYRNTQRPSGVPDRFSGSKSGTSASLAIGGLRSEDE ADYYCATWDDSLSAWVFGGGTKLTVLG | 51 |
| vlCDR1 | SSNIGSNF | 52 |
| vlCDR2 | RNT | 53 |
| vlCDR3 | ATWDDSLSAWV | 54 |
| Full length light chain (CPA.9.057.H4(S241P)) | QSVLTQPPSVSGTPGQRVTISCSGSSSNIGSNFVYWHQQLTGTAPKLLIYRNTQRPSGVPDRFSGSKSGTSASLAIGGLRSEDE ADYYCATWDDSLSAWVFGGGTKLTVLGQPKAAPSVTLFPPSSEELQANKATLVCLISDFYPGAVTVAWKADSSPVKAGVET TTPSKQSNNKYAASSYLSLTPEQWKSHRSYSCQVTHEGSTVEKTVAPTECS | 55 |

Figure 3E: CPA.9.059

| What | sequence | SEQ ID NO: |
|---|---|---|
| Variable heavy (vh) domain | EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARYSYGQYPYWGQGTLVTVSS | 56 |
| vhCDR1 | GFTVSSNY | 57 |
| vhCDR2 | IYSGGST | 58 |
| vhCDR3 | ARGARYSYGQYPY | 59 |
| Full length HC (IgG4(S241P); CPA.9.059.H4(S241P)) | EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARYSYGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 60 |
| Variable light (vl) domain | DIQLTQSPSFLSASVGDRVTITCRASHDISSLFSWYQQKPGKAPKLLIYAASTLQTGVPSRFSGSASGTEFTLTISSLQPEDFATYYCLQLDSFPTWTFGQGTKVEIKR | 61 |
| vlCDR1 | HDISSL | 62 |
| vlCDR2 | AAS | 63 |
| vlCDR3 | LQLDSFPTWT | 64 |
| Full length light chain (CPA.9.059.H4(S241P)) | DIQLTQSPSFLSASVGDRVTITCRASHDISSLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 65 |

Figure 3F: CPA.9.083

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSS | 66 |
| vhCDR1 | GFTFSSYA | 67 |
| vhCDR2 | ISYDGTPV | 68 |
| vhCDR3 | ARDPLPLHYYGMDV | 69 |
| Full length HC (IgG4(S241P); CPA.9.083.H4(S241P)) | EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 70 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLG | 71 |
| vlCDR1 | SSNMGRRP | 72 |
| vlCDR2 | SQN | 73 |
| vlCDR3 | AVWDGDRRSLQ | 74 |
| Full length light chain (CPA.9.083.H4(S241P)) | QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 75 |

Figure 3G: CPA.9.086

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSS | 76 |
| vhCDR1 | GFTFSSYA | 77 |
| vhCDR2 | ISYAGEVK | 78 |
| vhCDR3 | ARDPLPLHYYGMDV | 79 |
| Full length HC (IgG4(S241P); CPA.9.086.H4(S241P)) | EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 80 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCAVWDDIGRVLQLGGGTQLAVLG | 81 |
| vlCDR1 | SSNMGRRP | 82 |
| vlCDR2 | SQN | 83 |
| vlCDR3 | AVWDDIGRVLQ | 84 |
| Full length light chain (CPA.9.086.H4(S241P)) | QSALTQPRSASGNPGQRVTISCSGSSSNMGRRPVNWYQQIPGTAPKLLIYSQNQRPSGVPDRFSGSQSGTSASLTISGLQSEDEAEYFCAVWDDIGRVLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 85 |

Figure 3H: CPA.9.089

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDRTPVYYADSVKGRFTISRDNSKNTLYLQMNSLRAEDTAVYYCARDPLPLHYYGMDVWGQGTTVTVSS | 86 |
| vhCDR1 | GFTFSSYA | 87 |
| vhCDR2 | ISYDRTPV | 88 |
| vhCDR3 | ARDPLPLHYYGMDV | 89 |
| Full length HC (IgG4(S241P); CPA.9.089.H4(S241P)) | EVQLVETGGGLIQPGRSLRLSCAASGFTFSSYAMHWVRQAPGKGLEWVAVISYDRTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 90 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCATWDDSLPRLNFGGGTKLAVLG | 91 |
| vlCDR1 | SSNMGRRP | 92 |
| vlCDR2 | SQN | 93 |
| vlCDR3 | ATWDDSLPRLN | 94 |
| Full length light chain (CPA.9.089.H4(S241P)) | QSALTQPRSASGNPGQRVTISCSGSSSNMGRRPVNWYQQIPGTAPKLLIYSQNQRPSGVPDRFSGSQSGTSASLTISGLQSEDEAEYFCATWDDSLPRLNFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 95 |

Figure 3I: CPA.9.093

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYEGDRKYYADSVKGRFTISRDNSKNTLYLQMNSLRAEDTAVYYCARDPLPLHYYGMDVWGQGTTVTVSS | 96 |
| vhCDR1 | GFTFSSYA | 97 |
| vhCDR2 | ISYEGDRK | 98 |
| vhCDR3 | ARDPLPLHYYGMDV | 99 |
| Full length HC (IgG4(S241P); CPA.9.093.H4(S241P)) | EVQLVETGGGLIQPGRSLRLSCAASGFTFSSYAMHWVRQAPGKGLEWVAVISYEGDRKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 100 |
| Variable light (vl) domain | QSALTQPRSASGNPGQRVTISCSGSSSNMGRRPVNWYQQIPGTAPKLLIYSQNQRPSGVPDRFSGSQSGTSASLTISGLQSEDEAEYFCATWDDSTPHGVFGGGTKLAVLG | 101 |
| vlCDR1 | SSNMGRRP | 102 |
| vlCDR2 | SQN | 103 |
| vlCDR3 | ATWDDSTPHGV | 104 |
| Full length light chain (CPA.9.093.H4(S241P)) | QSALTQPRSASGNPGQRVTISCSGSSSNMGRRPVNWYQQIPGTAPKLLIYSQNQRPSGVPDRFSGSQSGTSASLTISGLQSEDEAEYFCATWDDSTPHGVFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 105 |

Figure 3: CPA.9.101

| What | sequence | SEQ ID NO: |
|---|---|---|
| Variable heavy (vh) domain | EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGAPLFGQYPYWGQGTLVTVSS | 106 |
| vhCDR1 | GFTVSSNY | 107 |
| vhCDR2 | IYSGGST | 108 |
| vhCDR3 | ARGAPLFGQYPY | 109 |
| Full length HC (IgG4(S241P); CPA.9.101.H4(S241P)) | EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGAPLFGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 110 |
| Variable light (vl) domain | DIQMTQSPSSLSASVGDRVTITCRASHAIASLFSWYQQKPGKAPKLLIYAASTLQTGVPSRFSGSASGTEFTLTISSLQPEDFATYYCLQLDSFPTWTFGQGTKVEIKR | 111 |
| vlCDR1 | HAIASL | 112 |
| vlCDR2 | AAS | 113 |
| vlCDR3 | LQLDSFPTWT | 114 |
| Full length light chain (CPA.9.101.H4(S241P)) | DIQMTQSPSSLSASVGDRVTITCRASHAIASLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 115 |

Figure 3K: CPA.9.103

| What | sequence | SEQ ID NO: |
|---|---|---|
| Variable heavy (vh) domain | EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARPNGQYPYWGQGTLVTVSS | 116 |
| vhCDR1 | GFTVSSNY | 117 |
| vhCDR2 | IYSGGST | 118 |
| vhCDR3 | ARGARPNGQYPY | 119 |
| Full length HC (IgG4(S241P); CPA.9.103.H4(S241P)) | EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARPNGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 120 |
| Variable light (vl) domain | DIQLTQSPSFLSASVGDRVTITCRASHGIKSLFSWYQQKPGKAPKLLIYAASTLQTGVPSRFSGSASGTEFTLTISSLQPEDFATYYCLQLDSFPTWTFGQGTKVEIKR | 121 |
| vlCDR1 | HGIKSL | 122 |
| vlCDR2 | AAS | 123 |
| vlCDR3 | LQLDSFPTWT | 124 |
| Full length light chain (CPA.9.103.H4(S241P)) | DIQLTQSPSFLSASVGDRVTITCRASHGIKSLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 125 |

Figure 3L:
BM26 hIgG4 (BM26-H4) (WO2016/028656A1, Clone 31C6)

| What | Sequence | SEQ ID NO: |
|---|---|---|
| Variable heavy (vh) domain | EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSS | 126 |
| vhCDR1 | GYTFSSYV | 127 |
| vhCDR2 | IDPYNDGA | 128 |
| vhCDR3 | ARGGPYGWYFDV | 129 |
| Full length HC (IgG4(S241P)) | EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 130 |
| Variable light (vl) domain | DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELK | 131 |
| vlCDR1 | EHIYSY | 132 |
| vlCDR2 | NAK | 133 |
| vlCDR3 | QHHFGSPLT | 134 |
| Full length light chain | DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 135 |

Figure 3M:
BM29 hIgG4 (BM29-H4) (US2016/0176963A1, Clone 22G2)

| What | sequence | SEQ ID NO: |
|---|---|---|
| Variable heavy (vh) domain | QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYFFGVDVWGQGTTVTVSS | 136 |
| vhCDR1 | GGSVSSGIYY | 137 |
| vhCDR2 | IYYSGST | 138 |
| vhCDR3 | ARDYYVSGNYYNVDYFFGVDV | 139 |
| Full length HC (IgG4(S241P)) | QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYFFGVDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 140 |
| Variable light (vl) domain | EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK | 141 |
| vlCDR1 | QSVSSY | 142 |
| vlCDR2 | DAS | 143 |
| vlCDR3 | QQRSNWPPLFT | 144 |
| Full length light chain | EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 145 |

Figure 3N: CHA.9.536.1

| What | Sequence | SEQ ID NO: |
|---|---|---|
| Variable heavy (vh) domain | QVQLVQSGAEVKKPGASVKVSCKASGYTFTEYTLHWVRQAPGQGLEWMGGINPNNGGTSYAQKFQGRVTMTRDTSTSTVYMELSSLRS EDTAVYYCARSGYYDYSFAYWGQGTLVTVSS | 146 |
| vhCDR1 | GYTFTEYTLH | 147 |
| vhCDR2 | GINPNNGGTS | 148 |
| vhCDR3 | SGYYDYSFAY | 149 |
| Full length HC (IgG4(S241P); CHA.9.536.1.H4(S241P)) | QVQLVQSGAEVKKPGASVKVSCKASGYTFTEYTLHWVRQAPGQGLEWMGGINPNNGGTSYAQKFQGRVTMTRDTSTSTVYMELSSLRS EDTAVYYCARSGYYDYSFAYWGQGTLVTVSSASTKGPSVFPLAPCSRSTSESTAALGCLVKDYFPEPVTVSWNSGALTSGVHTFPAVLQSSGL YSLSSVVTVPSSSLGTKTYTCNVDHKPSNTKVDKRVESKYGPPCPPCPAPEFLGGPSVFLFPPKPKDTLMISRTPEVTCVVVDVSQEDPEVQF NWYVDGVEVHNAKTKPREEQFNSTYRVVSVLTVLHQDWLNGKEYKCKVSNKGLPSSIEKTISKAKGQPREPQVYTLPPSQEEMTKNQVSLT CLVKGFYPSDIAVEWESNGQPENNYKTTPPVLDSDGSFFLYSRLTVDKSRWQEGNVFSCSVMHEALHNHYTQKSLSLSPGK | 150 |
| Variable light (vl) domain | DIQMTQSPSSLSASVGDRVTITCRASQDVKNAVVWYQQKPGKAPKLLIYSPSYRYTGVPSRFSGSGSGTDFTLTISSLQPEDFATYYCQQHYS TPFTFGQGTKLEIK | 151 |
| vlCDR1 | RASQDVKNAVV | 152 |
| vlCDR2 | SPSYRYT | 153 |
| vlCDR3 | QQHYSTPFT | 154 |
| Full length light chain (CHA.9.536.1.H4(S241P)) | DIQMTQSPSSLSASVGDRVTITCRASQDVKNAVVWYQQKPGKAPKLLIYSPSYRYTGVPSRFSGSGSGTDFTLTISSLQPEDFATYYCQQHYS TPFTFGQGTKLEIKRTVAAPSVFIFPPSDEQLKSGTASVVCLLNNFYPREAKVQWKVDNALQSGNSQESVTEQDSKDSTYSLSSTLTLSKADYE KHKVYACEVTHQGLSSPVTKSFNRGEC | 155 |

Figure 3O: CHA.9.536.3

| What | Sequence | SEQ ID NO: |
|---|---|---|
| Variable heavy (vh) domain | QVQLVQSGAEVKKPGASVKVSCKTSGYTFTEYTLHWVRQAPGQGLEWIGGINPNNGGTSYAQKFQGRVTMTVDTSTS TVYMELSSLRSEDTAVYYCAGSGYYDYSFAYWGQGTLVTVSS | 156 |
| vhCDR1 | GYTFTEYTLH | 157 |
| vhCDR2 | GINPNNGGTS | 158 |
| vhCDR3 | SGYYDYSFAY | 159 |
| Full length HC (IgG4(S241P) CHA.9.536.3.H4(S241P)) | QVQLVQSGAEVKKPGASVKVSCKTSGYTFTEYTLHWVRQAPGQGLEWIGGINPNNGGTSYAQKFQGRVTMTVDTSTS TVYMELSSLRSEDTAVYYCAGSGYYDYSFAYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 160 |
| Variable light (vl) domain | DIQMTQSPSSLSASVGDRVTITCRASQDVKNAVVWYQQKPGKAPKLLIYSPSYRYTGVPSRFSGSGSGTDFTL TISSLQPEDFATYYCQQHYSTPFTFGQGTKLEIK | 161 |
| vlCDR1 | RASQDVKNAVV | 162 |
| vlCDR2 | SPSYRYT | 163 |
| vlCDR3 | QQHYSTPFT | 164 |
| Full length light chain (CHA.9.536.1.H4(S241P)) | DIQMTQSPSSLSASVGDRVTITCRASQDVKNAVVWYQQKPGKAPKLLIYSPSYRYTGVPSRFSGSGSGTDFTL TISSLQPEDFATYYCQQHYSTPFTFGQGTKLEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 165 |

Figure 3P: CHA.9.536.4

| What | Sequence | SEQ ID NO: |
|---|---|---|
| Variable heavy (vh) domain | QVQLVQSGAEVKKPGASVKVSCKTSGYTFTEYTLHWVRQAPGQGLEWIGGINPNNGGTSYAQKFQGRVTMTVDTSTS TVYMELSSLRSEDTAVYYCAGSGYYDYSFAYWGQGTLVTVSS | 166 |
| vhCDR1 | GYTFTEYTLH | 167 |
| vhCDR2 | GINPNNGGTS | 168 |
| vhCDR3 | SGYYDYSFAY | 169 |
| Full length HC (IgG4(S241P); CHA.9.536.4.H4(S241P)) | QVQLVQSGAEVKKPGASVKVSCKTSGYTFTEYTLHWVRQAPGQGLEWIGGINPNNGGTSYAQKFQGRVTMTVDTSTS TVYMELSSLRSEDTAVYYCAGSGYYDYSFAYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 170 |
| Variable light (vl) domain | DIQMTQSPSSLSASVGDRVTITCRASQDVKNAVVWYQQKPGKAPKLLIYSPSYRYTGVPSRFSGSGSGTDFTF TISSVQPEDFATYYCQQHYSTPFTFGQGTKLEIK | 171 |
| vlCDR1 | RASQDVKNAVV | 172 |
| vlCDR2 | SPSYRYT | 173 |
| vlCDR3 | QQHYSTPFT | 174 |
| Full length light chain (CHA.9.536.4.H4(S241P)) | DIQMTQSPSSLSASVGDRVTITCRASQDVKNAVVWYQQKPGKAPKLLIYSPSYRYTGVPSRFSGSGSGTDFTF TISSVQPEDFATYYCQQHYSTPFTFGQGTKLLEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 175 |

Figure 3Q: CHA.9.536.5

| What | Sequence | SEQ ID NO: |
|---|---|---|
| Variable heavy (vh) domain | QVQLVQSGAEVKKPGASVKISCKTSGYTFTEYTLHWVRQAPGQGLEWIGGINPNNGGTSYAQKFQGRATLTVDTSTS TAYMELSSLRSEDTAVYYCAGSGYYDYSFAYWGQGTLVTVSS | 176 |
| vhCDR1 | GYTFTEYTLH | 177 |
| vhCDR2 | GINPNNGGTS | 178 |
| vhCDR3 | SGYYDYSFAY | 179 |
| Full length HC (IgG4(S241P); CHA.9.536.5.H4(S241P)) | QVQLVQSGAEVKKPGASVKISCKTSGYTFTEYTLHWVRQAPGQGLEWIGGINPNNGGTSYAQKFQGRATLTVDTSTS TAYMELSSLRSEDTAVYYCAGSGYYDYSFAYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 180 |
| Variable light (vl) domain | DIQMTQSPSSLSASVGDRVTITCRASQDVKNAVVWYQQKPGKAPKLLIYSPSYRYTGVPSRFSGSGSGTDFTL TISSLQPEDFATYYCQQHYSTPFTFGQGTKLEIK | 181 |
| vlCDR1 | RASQDVKNAVV | 182 |
| vlCDR2 | SPSYRYT | 183 |
| vlCDR3 | QQHYSTPFT | 184 |
| Full length light chain (CHA.9.536.5.H4(S241P)) | DIQMTQSPSSLSASVGDRVTITCRASQDVKNAVVWYQQKPGKAPKLLIYSPSYRYTGVPSRFSGSGSGTDFTL TISSLQPEDFATYYCQQHYSTPFTFGQGTKLEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 185 |

Figure 3R: CHA.9.536.6

| What | Sequence | SEQ ID NO: |
|---|---|---|
| Variable heavy (vh) domain | QVQLVQSGAEVKKPGASVKISCKTSGYTFTEYTLHWVRQAPGQGLEWIGGINPNNGGTSYAQKFQGRATLTVDTSTSTAYMELSSLRSEDTAVYYCAGSGYYDYSFAYWGQGTLVTVSS | 186 |
| vhCDR1 | GYTFTEYTLH | 187 |
| vhCDR2 | GINPNNGGTS | 188 |
| vhCDR3 | SGYYDYSFAY | 189 |
| Full length HC (IgG4(S241P); CHA.9.536.6.H4(S241P)) | QVQLVQSGAEVKKPGASVKISCKTSGYTFTEYTLHWVRQAPGQGLEWIGGINPNNGGTSYAQKFQGRATLTVDTSTSTAYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 190 |
| Variable light (vl) domain | DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIK | 191 |
| vlCDR1 | RASQDVKNAVV | 192 |
| vlCDR2 | SPSYRYT | 193 |
| vlCDR3 | QQHYSTPFT | 194 |
| Full length light chain (CHA.9.536.6.H4(S241P)) | DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 195 |

Figure 3S: CHA.9.536.7

| What | Sequence | SEQ ID NO: |
|---|---|---|
| Variable heavy (vh) domain | QVQLVQSGAEVKKPGASVKISCKTSGYTFTEYTLHWVRQAPGQGLEWIGGINPNNGGTSYAQKFQGRATLTVDKSTS TAYMELSSLRSEDTAVYYCAGSGYYDYSFAYWGQGTLVTVSS | 196 |
| vhCDR1 | GYTFTEYTLH | 197 |
| vhCDR2 | GINPNNGGTS | 198 |
| vhCDR3 | SGYYDYSFAY | 199 |
| Full length HC (IgG4(S241P); CHA.9.536.7.H4(S241P)) | QVQLVQSGAEVKKPGASVKISCKTSGYTFTEYTLHWVRQAPGQGLEWIGGINPNNGGTSYAQKFQGRATLTVDKSTS TAYMELSSLRSEDTAVYYCAGSGYYDYSFAYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 200 |
| Variable light (vl) domain | DIQMTQSPSSLSASVGDRVTITCRASQDVKNAVVWYQQKPGKAPKLLIYSPSYRYTGVPSRFSGSGSGTDFTL TISSLQPEDFATYYCQQHYSTPFTFGQGTKLEIK | 201 |
| vlCDR1 | RASQDVKNAVV | 202 |
| vlCDR2 | SPSYRYT | 203 |
| vlCDR3 | QQHYSTPFT | 204 |
| Full length light chain (CHA.9.536.7.H4(S241P)) | DIQMTQSPSSLSASVGDRVTITCRASQDVKNAVVWYQQKPGKAPKLLIYSPSYRYTGVPSRFSGSGSGTDFTL TISSLQPEDFATYYCQQHYSTPFTFGQGTKLEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 205 |

Figure 3T: CHA.9.536.8

| What | Sequence | SEQ ID NO: |
|---|---|---|
| Variable heavy (vh) domain | QVQLVQSGAEVKKPGASVKISCKTSGYTFTEYTLHWVRQAPGQGLEWIGGINPNNGGTSYAQKFQGRATLTVDKSTSTAYMELSSLRSEDTAVYYCAGSGYYDYSFAYWGQGTLVTVSS | 206 |
| vhCDR1 | GYTFTEYTLH | 207 |
| vhCDR2 | GINPNNGGTS | 208 |
| vhCDR3 | SGYYDYSFAY | 209 |
| Full length HC (IgG4(S241P); CHA.9.536.8.H4(S241P)) | QVQLVQSGAEVKKPGASVKISCKTSGYTFTEYTLHWVRQAPGQGLEWIGGINPNNGGTSYAQKFQGRATLTVDKSTSTAYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 210 |
| Variable light (vl) domain | DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIK | 211 |
| vlCDR1 | RASQDVKNAVV | 212 |
| vlCDR2 | SPSYRYT | 213 |
| vlCDR3 | QQHYSTPFT | 214 |
| Full length light chain (CHA.9.536.8.H4(S241P)) | DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 215 |

Figure 3U: CHA.9.560.1

| What | Sequence | SEQ ID NO: |
|---|---|---|
| Variable heavy (vh) domain | QVQLVQSGAEVKKPGASVKVSCKASGYTFTNYGMNWVRQAPGQGLEWMGWINTYTGEPTYAQKFQGRVTMTRDTSTS TVYMELSSLRSEDTAVYYCARGNGYYVGMDYWGQGTLVTVSS | 216 |
| vhCDR1 | GYTFTNYGMN | 217 |
| vhCDR2 | WINTYTGEPT | 218 |
| vhCDR3 | GNGYYVGMDY | 219 |
| Full length HC (IgG4(S241P); CHA.9.560.1.H4(S241P)) | QVQLVQSGAEVKKPGASVKVSCKASGYTFTNYGMNWVRQAPGQGLEWMGWINTYTGEPTYAQKFQGRVTMTRDTSTS TVYMELSSLRSEDTAVYYCARGNGYYVGMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 220 |
| Variable light (vl) domain | QAVVTQEPSLTVSPGGTVTLTCRSSTGAVTTSNHANWFQQKPGQAPRTLIYGTNGRGSWTPARFSGSLLGGKAALTL SGAQPEDEAEYYCALWFSNHWVFGGGTKLTVL | 221 |
| vlCDR1 | RSSTGAVTTSNHAN | 222 |
| vlCDR2 | GTNGRGS | 223 |
| vlCDR3 | ALWFSNHWV | 224 |
| Full length light chain (CHA.9.560.1.H4(S241P)) | QAVVTQEPSLTVSPGGTVTLTCRSSTGAVTTSNHANWFQQKPGQAPRTLIYGTNGRGSWTPARFSGSLLGGKAALTL SGAQPEDEAEYYCALWFSNHWVFGGGTKLTVLQPKAAPSVTLFPPSSEELQANKATLVCLISDFYPGAVTVAWKADSSPVK AGVETTTPSKQSNNKYAASSYLSLTPEQWKSHRSYSCQVTHEGSTVEKTVAPTECS | 225 |

Figure 3V: CHA.9.560.3

| What | Sequence | SEQ ID NO: |
|---|---|---|
| Variable heavy (vh) domain | QVQLVQSGAEVKKPGASVKVSCKASGYTFTNYGMNWVRQAPGQGLEWMGWINTYTGEPTYAQKFQGRVTMTLDTSTSTAYMELSSLRSEDTAVYYCSRGNGYYVGMDYWGQGTLVTVSS | 226 |
| vhCDR1 | GYTFTNYGMN | 227 |
| vhCDR2 | WINTYTGEPT | 228 |
| vhCDR3 | GNGYYVGMDY | 229 |
| Full length HC (IgG4(S241P); CHA.9.560.3.H4(S241P)) | QVQLVQSGAEVKKPGASVKVSCKASGYTFTNYGMNWVRQAPGQGLEWMGWINTYTGEPTYAQKFQGRVTMTLDTSTSTAYMELSSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 230 |
| Variable light (vl) domain | QAVVTQEPSLTVSPGGTVTLTCGSSTGAVTTSNHANWVQQKPGQAFRGLIRGTNGRGSWTPARFSGSLLGGKAALTISGAQPEDEAEYYCALWFSNHWVFGGGTKLTVL | 231 |
| vlCDR1 | GSSTGAVTTSNHAN | 232 |
| vlCDR2 | GTNGRGS | 233 |
| vlCDR3 | ALWFSNHWV | 234 |
| Full length light chain (CHA.9.560.3.H4(S241P)) | QAVVTQEPSLTVSPGGTVTLTCGSSTGAVTTSNHANWVQQKPGQAFRGLIRGTNGRGSWTPARFSGSLLGGKAALTISGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 235 |

Figure 3W: CHA.9.560.4

| What | Sequence | SEQ ID NO: |
|---|---|---|
| Variable heavy (vh) domain | QVQLVQSGAEVKKPGASVKVSCKASGYTFTNYGMNWVRQAPGQGLEWMGWINTYTGEPTYAQKFQGRVTMTLDTSTS TAYMELSSLRSEDTAVYYCSRGNGYYVGMDYWGQGTLVTVSS | 236 |
| vhCDR1 | GYTFTNYGMN | 237 |
| vhCDR2 | WINTYTGEPT | 238 |
| vhCDR3 | GNGYYVGMDY | 239 |
| Full length HC (IgG4(S241P); CHA.9.560.4.H4(S241P)) | QVQLVQSGAEVKKPGASVKVSCKASGYTFTNYGMNWVRQAPGQGLEWMGWINTYTGEPTYAQKFQGRVTMTLDTSTS TAYMELSSLRSEDTAVYYCSRGNGYYVGMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 240 |
| Variable light (vl) domain | QAVVTQEPSLTVSPGGTVTLTCGSSTGAVTTSNHANWVQQKPGQAFRGLIRGTNGRGSGVPARFSGSLLGGKAALTI SGAQPEDEAEYYCALWFSNHWVFGGGTKLTVL | 241 |
| vlCDR1 | GSSTGAVTTSNHAN | 242 |
| vlCDR2 | GTNGRGS | 243 |
| vlCDR3 | ALWFSNHWV | 244 |
| Full length light chain (CHA.9.560.4.H4(S241P)) | QAVVTQEPSLTVSPGGTVTLTCGSSTGAVTTSNHANWVQQKPGQAFRGLIRGTNGRGSGVPARFSGSLLGGKAALTI SGAQPEDEAEYYCALWFSNHWVFGGGTKLTVLQPKAAPSVTLFPPSSEELQANKATLVCLISDFYPGAVTVAWKADSSPVK AGVETTTPSKQSNNKYAASSYLSLTPEQWKSHRSYSCQVTHEGSTVEKTVAPTECS | 245 |

Figure 3X: CHA.9.560.5

| What | Sequence | SEQ ID NO: |
|---|---|---|
| Variable heavy (vh) domain | QVQLVQSGAEVKKPGASVKISCKASGYTFTNYGMNWVRQAPGQGLEWMGWINTYTGEPTYAQKFQGRFTFTLDTSTS TAYLEISSLRSEDTAVYYCSRGNGYYVGMDYWGQGTLVTVSS | 246 |
| vhCDR1 | GYTFTNYGMN | 247 |
| vhCDR2 | WINTYTGEPT | 248 |
| vhCDR3 | GNGYYVGMDY | 249 |
| Full length HC (IgG4(S241P); CHA.9.560.5.H4(S241P)) | QVQLVQSGAEVKKPGASVKISCKASGYTFTNYGMNWVRQAPGQGLEWMGWINTYTGEPTYAQKFQGRFTFTLDTSTS TAYLEISSLRSEDTAVYYCSRGNGYYVGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 250 |
| Variable light (vl) domain | QAVVTQEPSLTVSPGGTVTLTCGSSTGAVTTSNHANWVQQKPGQAFRGLIRGTNGRGSWTPARFSGSLLGGKAALTI SGAQPEDEAEYYCALWFSNHWVFGGGTKLTVL | 251 |
| vlCDR1 | GSSTGAVTTSNHAN | 252 |
| vlCDR2 | GTNGRGS | 253 |
| vlCDR3 | ALWFSNHWV | 254 |
| Full length light chain (CHA.9.560.5.H4(S241P)) | QAVVTQEPSLTVSPGGTVTLTCGSSTGAVTTSNHANWVQQKPGQAFRGLIRGTNGRGSWTPARFSGSLLGGKAALTI SGAQPEDEAEYYCALWFSNHWVFGGGTKLTVLQPKAAPSVTLFPPSSEELQANKATLVCLISDFYPGAVTVAWKADSSPVK AGVETTTPSKQSNNKYAASSYLSLTPEQWKSHRSYSCQVTHEGSTVEKTVAPTECS | 255 |

Figure 3Y: CHA.9.560.6

| What | Sequence | SEQ ID NO: |
|---|---|---|
| Variable heavy (vh) domain | QVQLVQSGAEVKKPGASVKISCKASGYTFTNYGMNWVRQAPGQGLEWMGWINTYTGEPTYAQKFQGRFTFTLDTSTS TAYLEISSLRSEDTAVYYCSRGNGYYVGMDYWGQGTLVTVSS | 256 |
| vhCDR1 | GYTFTNYGMN | 257 |
| vhCDR2 | WINTYTGEPT | 258 |
| vhCDR3 | GNGYYVGMDY | 259 |
| Full length HC (IgG4(S241P); CHA.9.560.6.H4(S241P)) | QVQLVQSGAEVKKPGASVKISCKASGYTFTNYGMNWVRQAPGQGLEWMGWINTYTGEPTYAQKFQGRFTFTLDTSTS TAYLEISSLRSEDTAVYYCSRGNGYYVGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 260 |
| Variable light (vl) domain | QAVVTQEPSLTVSPGGTVTLTCGSSTGAVTTSNHANWVQQKPGQAFRGLIRGTNGRGSGVPARFSGSLLGGKAALTI SGAQPEDEAEYYCALWFSNHWVFGGGTKLTVL | 261 |
| vlCDR1 | GSSTGAVTTSNHAN | 262 |
| vlCDR2 | GTNGRGS | 263 |
| vlCDR3 | ALWFSNHWV | 264 |
| Full length light chain (CHA.9.560.6.H4(S241P)) | QAVVTQEPSLTVSPGGTVTLTCGSSTGAVTTSNHANWVQQKPGQAFRGLIRGTNGRGSGVPARFSGSLLGGKAALTI SGAQPEDEAEYYCALWFSNHWVFGGGTKLTVLQPKAAPSVTLFPPSSEELQANKATLVCLISDFYPGAVTVAWKADSSPVK AGVETTTPSKQSNNKYAASSYLSLTPEQWKSHRSYSCQVTHEGSTVEKTVAPTECS | 265 |

Figure 3Z: CHA.9.560.7

| What | Sequence | SEQ ID NO: |
|---|---|---|
| Variable heavy (vh) domain | QVQLVQSGAEVKKPGASVKISCKASGYTFTNYGMNWVRQAPGQGLEWMGWINTYTGEPTYAQKFQGRFTFTLDASTS TAYLEISSLRSEDTAVYYCSRGNGYYVGMDYWGQGTLVTVSS | 266 |
| vhCDR1 | GYTFTNYGMN | 267 |
| vhCDR2 | WINTYTGEPT | 268 |
| vhCDR3 | GNGYYVGMDY | 269 |
| Full length HC (IgG4(S241P); CHA.9.560.7.H4(S241P)) | QVQLVQSGAEVKKPGASVKISCKASGYTFTNYGMNWVRQAPGQGLEWMGWINTYTGEPTYAQKFQGRFTFTLDTSTS TAYLEISSLRSEDTAVYYCSRGNGYYVGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 270 |
| Variable light (vl) domain | QAVVTQEPSLTVSPGGTVTLTCGSSTGAVTTSNHANWVQQKPGQAFRGLIRGTNGRGSWTPARFSGSLLGGKAALTI SGAQPEDEAEYYCALWFSNHWVFGGGTKLTVL | 271 |
| vlCDR1 | GSSTGAVTTSNHAN | 272 |
| vlCDR2 | GTNGRGS | 273 |
| vlCDR3 | ALWFSNHWV | 274 |
| Full length light chain (CHA.9.560.7.H4(S241P)) | QAVVTQEPSLTVSPGGTVTLTCGSSTGAVTTSNHANWVQQKPGQAFRGLIRGTNGRGSWTPARFSGSLLGGKAALTI SGAQPEDEAEYYCALWFSNHWVFGGGTKLTVLQPKAAPSVTLFPPSSEELQANKATLVCLISDFYPGAVTVAWKADSSPVK AGVETTTPSKQSNNKYAASSYLSLTPEQWKSHRSYSCQVTHEGSTVEKTVAPTECS | 275 |

Figure 3AA: CHA.9.560.8

| What | Sequence | SEQ ID NO: |
|---|---|---|
| Variable heavy (vh) domain | QVQLVQSGAEVKKPGASVKISCKASGYTFTNYGMNWVRQAPGQGLEWMGWINTYTGEPTYAQKFQGRFTFTLDASTS TAYLEISSLRSEDTAVYYCSRGNGYYVGMDYWGQGTLVTVSS | 276 |
| vhCDR1 | GYTFTNYGMN | 277 |
| vhCDR2 | WINTYTGEPT | 278 |
| vhCDR3 | GNGYYVGMDY | 279 |
| Full length HC (IgG4(S241P); CHA.9.560.8.H4(S241P)) | QVQLVQSGAEVKKPGASVKISCKASGYTFTNYGMNWVRQAPGQGLEWMGWINTYTGEPTYAQKFQGRFTFTLDASTS TAYLEISSLRSEDTAVYYCSRGNGYYVGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 280 |
| Variable light (vl) domain | QAVVTQEPSLTVSPGGTVTLTCGSSTGAVTTSNHANWVQQKPGQAFRGLIRGTNGRGSGVPARFSGSLLGGKAALTI SGAQPEDEAEYYCALWFSNHWVFGGGTKLTVL | 281 |
| vlCDR1 | GSSTGAVTTSNHAN | 282 |
| vlCDR2 | GTNGRGS | 283 |
| vlCDR3 | ALWFSNHWV | 284 |
| Full length light chain (CHA.9.560.8.H4(S241P)) | QAVVTQEPSLTVSPGGTVTLTCGSSTGAVTTSNHANWVQQKPGQAFRGLIRGTNGRGSGVPARFSGSLLGGKAALTI SGAQPEDEAEYYCALWFSNHWVFGGGTKLTVLQPKAAPSVTLFPPSSEELQANKATLVCLISDFYPGAVTVAWKADSSPVK AGVETTTPSKQSNNKYAASSYLSLTPEQWKSHRSYSCQVTHEGSTVEKTVAPTECS | 285 |

Figure 3BB: CHA.9.546.1

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCARWLLSYYAMDYWGQGTLVTVSS | 286 |
| vhCDR1 | GFTFSSYIMS | 287 |
| vhCDR2 | TISGGGTNTY | 288 |
| vhCDR3 | WLLSYYAMDY | 289 |
| Full length HC (IgG4(S241P); CHA.9.546.1.H4(S241P)) | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCARWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 290 |
| Variable light (vl) domain | DIQMTQSPSSLSASVGDRVTITCRASQNINVWLTWYQQKPGKAPKLLIYKASNLHTGVPSRFSGSGSGTDFTLTISS LQPEDFATYYCQQGQSYPYTFGQGTKLEIK | 291 |
| vlCDR1 | RASQNINVWLT | 292 |
| vlCDR2 | KASNLHT | 293 |
| vlCDR3 | QQGQSYPYT | 294 |
| Full length light chain (CHA.9.546.1.H4(S241P)) | DIQMTQSPSSLSASVGDRVTITCRASQNINVWLTWYQQKPGKAPKLLIYKASNLHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 295 |

Figure 3CC: CHA.9.547.1

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCAKWLLSYYAMDYWGQGTLVTVSS | 296 |
| vhCDR1 | GFTFSSYIMS | 297 |
| vhCDR2 | TISGGGTNTY | 298 |
| vhCDR3 | WLLSYYAMDY | 299 |
| Full length HC (IgG4(S241P); CHA.9.547.1.H4(S241P)) | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 300 |
| Variable light (vl) domain | DIQMTQSPSSLSASVGDRVTITCRASQNINVWLTWYQQKPGKAPKLLIYKASNLHTGVPSRFSGSGSGTDFTLTISS LQPEDFATYYCQQGQSYPYTFGQGTKLEIK | 301 |
| vlCDR1 | RASQNINVWLT | 302 |
| vlCDR2 | KASNLHT | 303 |
| vlCDR3 | QQGQSYPYT | 304 |
| Full length light chain (CHA.9.547.1.H4(S241P)) | DIQMTQSPSSLSASVGDRVTITCRASQNINVWLTWYQQKPGKAPKLLIYKASNLHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 305 |

Figure 3DD: CHA.9.547.2

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYADSVKGRFTISRDNSKN TLYLQMNSLRAEDTAVYYCAKWLLSYYAMDYWGQGTLVTVSS | 306 |
| vhCDR1 | GFTFSSYIMS | 307 |
| vhCDR2 | TISGGGTNTY | 308 |
| vhCDR3 | WLLSYYAMDY | 309 |
| Full length HC (IgG4(S241P); CHA.9.547.2.H4(S241P)) | EVQLVESGGGLVQPGGSLRLSCAASGFTFSSYIMSWVRQAPGKGLEWVATISGGGTNTYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 310 |
| Variable light (vl) domain | DIQMTQSPSSLSASVGDRVTITCRASQNINVWLTWYQQKPGKAPKLLIYKASNLHTGVPSRFSGSGSGTDFTLTISS LQPEDFATYYCQQGQSYPYTFGQGTKLEIK | 311 |
| vlCDR1 | RASQNINVWLT | 312 |
| vlCDR2 | KASNLHT | 313 |
| vlCDR3 | QQGQSYPYT | 314 |
| Full length light chain (CHA.9.547.2.H4(S241P)) | DIQMTQSPSSLSASVGDRVTITCRASQNINVWLTWYQQKPGKAPKLLIYKASNLHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 315 |

Figure 3EE: CHA.9.547.3

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCAKWLLSYYAMDYWGQGTLVTVSS | 316 |
| vhCDR1 | GFTFSSYIMS | 317 |
| vhCDR2 | TISGGGTNTY | 318 |
| vhCDR3 | WLLSYYAMDY | 319 |
| Full length HC (IgG4(S241P); CHA.9.547.3.H4(S241P)) | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 320 |
| Variable light (vl) domain | DIQMTQSPSSLSASVGDRITITCRASQNINVWLTWYQQKPGKAPKLLIYKASNLHTGVPSRFSGSGSGTDFTLTISS LQPEDFATYYCQQGQSYPYTFGQGTKLEIK | 321 |
| vlCDR1 | RASQNINVWLT | 322 |
| vlCDR2 | KASNLHT | 323 |
| vlCDR3 | QQGQSYPYT | 324 |
| Full length light chain (CHA.9.547.3.H4(S241P)) | DIQMTQSPSSLSASVGDRITITCRASQNINVWLTWYQQKPGKAPKLLIYKASNLHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 325 |

Figure 3FF: CHA.9.547.4

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYADSVKGRFTISRDNSKNTLYLQMNSLRAEDTAVYYCAKWLLSYYAMDYWGQGTLVTVSS | 326 |
| vhCDR1 | GFTFSSYIMS | 327 |
| vhCDR2 | TISGGGTNTY | 328 |
| vhCDR3 | WLLSYYAMDY | 329 |
| Full length HC (IgG4(S241P); CHA.9.547.4.H4(S241P)) | EVQLVESGGGLVQPGGSLRLSCAASGFTFSSYIMSWVRQAPGKGLEWVATISGGGTNTYADSVKGRFTISRDNSKNTLYLQMNSLRAEDTAVYYCAKWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 330 |
| Variable light (vl) domain | DIQMTQSPSSLSASVGDRITITCRASQNINVWLTWYQQKPGKAPKLLIYKASNLHTGVPSRFSGSGSGTDFTLTISSLQPEDFATYYCQQGQSYPYTFGQGTKLEIK | 331 |
| vlCDR1 | RASQNINVWLT | 332 |
| vlCDR2 | KASNLHT | 333 |
| vlCDR3 | QQGQSYPYT | 334 |
| Full length light chain CHA.9.547.4.H4(S241P)) | DIQMTQSPSSLSASVGDRITITCRASQNINVWLTWYQQKPGKAPKLLIYKASNLHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 335 |

Figure 3GG: CHA.9.547.6

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCAKWLLSYYAMDYWGQGTLVTVSS | 336 |
| vhCDR1 | GFTFSSYIMS | 337 |
| vhCDR2 | TISGGGTNTY | 338 |
| vhCDR3 | WLLSYYAMDY | 339 |
| Full length HC (IgG4(S241P); CHA.9.547.6.H4(S241P)) | EVQLVESGGGLVQPGGSLRLSCAASGFTFSSYIMSWVRQAPGKGLEWVSTISGGGTNTYYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 340 |
| Variable light (vl) domain | DIQMTQSPSSLSASVGDRVTITCRASQNINVWLTWYQQKPGKAPKLLIYKASKSHTGVPSRFSGSGSGTDFTLTISS LQPEDFATYYCQQGQSYPYTFGQGTKLEIK | 341 |
| vlCDR1 | RASQNINVWLT | 342 |
| vlCDR2 | KASKSHT | 343 |
| vlCDR3 | QQGQSYPYT | 344 |
| Full length light chain (CHA.9.547.6.H4(S241P)) | DIQMTQSPSSLSASVGDRVTITCRASQNINVWLTWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 345 |

Figure 3HH: CHA.9.547.7

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYADSVKGRFTISRDNSKN TLYLQMNSLRAEDTAVYYCAKWLLSYYAMDYWGQGTLVTVSS | 346 |
| vhCDR1 | GFTFSSYIMS | 347 |
| vhCDR2 | TISGGGTNTY | 348 |
| vhCDR3 | WLLSYYAMDY | 349 |
| Full length HC (IgG4(S241P) for CHA.9.547.7.H4(S241P)) | EVQLVESGGGLVQPGGSLRLSCAASGFTFSSYIMSWVRQAPGKGLEWVATISGGGTNTYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 350 |
| Variable light (vl) domain | DIQMTQSPSSLSASVGDRVTITCRASQNINVWLTWYQQKPGKAPKLLIYKASKSHTGVPSRFSGSGSGTDFTLTISS LQPEDFATYYCQQGQSYPYTFGQGTKLEIK | 351 |
| vlCDR1 | RASQNINVWLT | 352 |
| vlCDR2 | KASKSHT | 353 |
| vlCDR3 | QQGQSYPYT | 354 |
| Full length light chain for CHA.9.547.7.H4(S241P) | DIQMTQSPSSLSASVGDRVTITCRASQNINVWLTWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 355 |

Figure 3II: CHA.9.547.8

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYADSVKGRFTISRDNSKN TLYLQMNSLRAEDTAVYYCAKWLLSYYAMDYWGQGTLVTVSS | 356 |
| vhCDR1 | GFTFSSYIMS | 357 |
| vhCDR2 | TISGGGTNTY | 358 |
| vhCDR3 | WLLSYYAMDY | 359 |
| Full length HC (IgG4(S241P); CHA.9.547.8.H4(S241P)) | EVQLVESGGGLVQPGGSLRLSCAASGFTFSSYIMSWVRQAPGKGLEWVSTISGGGTNTYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 360 |
| Variable light (vl) domain | DIQMTQSPSSLSASVGDRITITCRASQNINVWLTWYQQKPGKAPKLLIYKASKSHTGVPSRFSGSGSGTDFTLTISS LQPEDFATYYCQQGQSYPYTFGQGTKLEIK | 361 |
| vlCDR1 | RASQNINVWLT | 362 |
| vlCDR2 | KASKSHT | 363 |
| vlCDR3 | QQGQSYPYT | 364 |
| Full length light chain (CHA.9.547.8.H4(S241P)) | DIQMTQSPSSLSASVGDRITITCRASQNINVWLTWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 365 |

Figure 3JJ: CHA.9.547.9

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYYADSVKGRFTISRDNSKN TLYLQMNSLRAEDTAVYYCAKWLLSYYAMDYWGQGTLVTVSS | 366 |
| vhCDR1 | GFTFSSYIMS | 367 |
| vhCDR2 | TISGGGTNTY | 368 |
| vhCDR3 | WLLSYYAMDY | 369 |
| Full length HC (IgG4(S241P); CHA.9.547.9.H4(S241P)) | EVQLVESGGGLVQPGGSLRLSCAASGFTFSSYIMSWVRQAPGKGLEWVATISGGGTNTYYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 370 |
| Variable light (vl) domain | DIQMTQSPSSLSASVGDRITITCRASQNINVWLTWYQQKPGKAPKLLIYKASKSHTGVPSRFSGSGSGTDFTLTISS LQPEDFATYYCQQGQSYPYTFGQGTKLEIK | 371 |
| vlCDR1 | RASQNINVWLT | 372 |
| vlCDR2 | KASKSHT | 373 |
| vlCDR3 | QQGQSYPYT | 374 |
| Full length light chain (CHA.9.547.9.H4(S241P)) | DIQMTQSPSSLSASVGDRITITCRASQNINVWLTWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 375 |

Figure 3KK: CHA.9.541.1

| What | Sequence | SEQ ID NO: |
|---|---|---|
| Variable heavy (vh) domain | QVQLVQSGAEVKKPGASVKVSCKASGYTITNYGMNWVRQAPGQGLEWMGWINTYTGEPTYAQKFQGRVTMTRDTSTS TVYMELSSLRSEDTAVYYCARGNGNPLGMDYWGQGTLVTVSS | 376 |
| vhCDR1 | GYTITNYGMN | 377 |
| vhCDR2 | WINTYTGEPT | 378 |
| vhCDR3 | GNGNPLGMDY | 379 |
| Full length HC (IgG4(S241P); CHA.9.541.1.H4(S241P)) | QVQLVQSGAEVKKPGASVKVSCKASGYTITNYGMNWVRQAPGQGLEWMGWINTYTGEPTYAQKFQGRVTMTRDTSTS TVYMELSSLRSEDTAVYYCARGNGNPLGMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 380 |
| Variable light (vl) domain | EIVLTQSPATLSLSPGERATLSCGNGNPLGMDYWYQQKPGQAPRLLIYDTSKLASGIPARFSGSGSGTDFTLTISSL EPEDFAVYYCFQGSGYPLTFGQGTKLEIK | 381 |
| vlCDR1 | GNGNPLGMDY | 382 |
| vlCDR2 | DTSKLAS | 383 |
| vlCDR3 | FQGSGYPLT | 384 |
| Full length light chain (CHA.9.541.1.H4(S241P)) | EIVLTQSPATLSLSPGERATLSCGNGNPLGMDYWYQQKPGQAPRLLIYDTSKLASGIPARFSGSGSGTDFTLTISSL EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 385 |

Figure 3LL: CHA.9.541.3

| What | Sequence | SEQ ID NO: |
|---|---|---|
| Variable heavy (vh) domain | QVQLVQSGAEVKKPGASVKVSCKASGYTITNYGMNWVRQAPGQGLEWMGWINTYTGEPTYAQKFQGRFTMTLDTSTS TVYMELSSLRSEDTAVYYCARGNGNPLGMDYWGQGTLVTVSS | 386 |
| vhCDR1 | GYTITNYGMN | 387 |
| vhCDR2 | WINTYTGEPT | 388 |
| vhCDR3 | GNGNPLGMDY | 389 |
| Full length HC (IgG4(S241P); CHA.9.541.3.H4(S241P)) | QVQLVQSGAEVKKPGASVKVSCKASGYTITNYGMNWVRQAPGQGLEWMGWINTYTGEPTYAQKFQGRFTMTLDTSTS TVYMELSSLRSEDTAVYYCARGNGNPLGMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 390 |
| Variable light (vl) domain | EIVLTQSPATLSLSPGERATLSCGNGNPLGMDYWYQQKPGQAPRLLIYDTSKLASGIPARFSGSGSGTDYTLTISSL EPEDFAVYYCFQGSGYPLTFGQGTKLEIK | 391 |
| vlCDR1 | GNGNPLGMDY | 392 |
| vlCDR2 | DTSKLAS | 393 |
| vlCDR3 | FQGSGYPLT | 394 |
| Full length light chain (CHA.9.541.3.H4(S241P)) | EIVLTQSPATLSLSPGERATLSCGNGNPLGMDYWYQQKPGQAPRLLIYDTSKLASGIPARFSGSGSGTDYTLTISSL EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 395 |

Figure 3MM: CHA.9.541.4

| What | Sequence | SEQ ID NO: |
|---|---|---|
| Variable heavy (vh) domain | QVQLVQSGAEVKKPGASVKVSCKASGYTITNYGMNWVRQAPGQGLEWMGWINTYTGEPTYAQKFQGRFTMTLDTSTS TVYMELSSLRSEDTAVYYCARGNGNPLGMDYWGQGTLVTVSS | 396 |
| vhCDR1 | GYTITNYGMN | 397 |
| vhCDR2 | WINTYTGEPT | 398 |
| vhCDR3 | GNGNPLGMDY | 399 |
| Full length HC (IgG4(S241P); CHA.9.541.4.H4(S241P)) | QVQLVQSGAEVKKPGASVKVSCKASGYTITNYGMNWVRQAPGQGLEWMGWINTYTGEPTYAQKFQGRFTMTLDTSTS TVYMELSSLRSEDTAVYYCARGNGNPLGMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 400 |
| Variable light (vl) domain | EIVLTQSPATLSLSPGERATLSCGNGNPLGMDYWYQQKPGQAPRLWIYDTSKLASGVPARFSGSGSGTDYTLTISSL EPEDFAVYYCFQGSGYPLTFGQGTKLEIK | 401 |
| vlCDR1 | GNGNPLGMDY | 402 |
| vlCDR2 | DTSKLAS | 403 |
| vlCDR3 | FQGSGYPLT | 404 |
| Full length light chain (CHA.9.541.4.H4(S241P)) | EIVLTQSPATLSLSPGERATLSCGNGNPLGMDYWYQQKPGQAPRLWIYDTSKLASGVPARFSGSGSGTDYTLTISSL EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 405 |

Figure 3NN CHA.9.541.5

| What | Sequence | SEQ ID NO: |
|---|---|---|
| Variable heavy (vh) domain | QVQLVQSGAEVKKPGASVKVSCKASGYTITNYGMNWVRQAPGQGLEWMGWINTYTGEPTYAQKFQGRFTMTLDTSTS TVYMELSSLRSEDTAVYYCARGNGNPLGMDYWGQGTLVTVSS | 406 |
| vhCDR1 | GYTITNYGMN | 407 |
| vhCDR2 | WINTYTGEPT | 408 |
| vhCDR3 | GNGNPLGMDY | 409 |
| Full length HC (IgG4(S241P); CHA.9.541.5.H4(S241P)) | QVQLVQSGAEVKKPGASVKVSCKASGYTITNYGMNWVRQAPGQGLEWMGWINTYTGEPTYAQKFQGRFTMTLDTSTS TVYMELSSLRSEDTAVYYCARGNGNPLGMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 410 |
| Variable light (vl) domain | EIVLTQSPATLSLSPGERVTMSCGNGNPLGMDYWYQQKPGQAPRLWIYDTSKLASGVPARFSGSGSGTDYTLTISSM EPEDFAVYYCFQGSGYPLTFGQGTKLEIK | 411 |
| vlCDR1 | GNGNPLGMDY | 412 |
| vlCDR2 | DTSKLAS | 413 |
| vlCDR3 | FQGSGYPLT | 414 |
| Full length light chain (CHA.9.541.5.H4(S241P)) | EIVLTQSPATLSLSPGERVTMSCGNGNPLGMDYWYQQKPGQAPRLWIYDTSKLASGVPARFSGSGSGTDYTLTISSM EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 415 |

Figure 3OO: CHA.9.541.6

| What | Sequence | SEQ ID NO: |
|---|---|---|
| Variable heavy (vh) domain | QVQLVQSGAEVKKPGASVKISCKASGYTITNYGMNWVRQAPGQGLEWMGWINTYTGEPTYAQKFQGRFTITLDTSTS TVYLEISSLRSEDTAVYYCARGNGNPLGMDYWGQGTLVTVSS | 416 |
| vhCDR1 | GYTITNYGMN | 417 |
| vhCDR2 | WINTYTGEPT | 418 |
| vhCDR3 | GNGNPLGMDY | 419 |
| Full length HC (IgG4(S241P); CHA.9.541.6.H4(S241P)) | QVQLVQSGAEVKKPGASVKISCKASGYTITNYGMNWVRQAPGQGLEWMGWINTYTGEPTYAQKFQGRFTITLDTSTS TVYLEISSLRSEDTAVYYCARGNGNPLGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 420 |
| Variable light (vl) domain | EIVLTQSPATLSLSPGERATLSCGNGNPLGMDYWYQQKPGQAPRLLIYDTSKLASGIPARFSGSGSGTDYTLTISSL EPEDFAVYYCFQGSGYPLTFGQGTKLEIK | 421 |
| vlCDR1 | GNGNPLGMDY | 422 |
| vlCDR2 | DTSKLAS | 423 |
| vlCDR3 | FQGSGYPLT | 424 |
| Full length light chain (CHA.9.541.6.H4(S241P)) | EIVLTQSPATLSLSPGERATLSCGNGNPLGMDYWYQQKPGQAPRLLIYDTSKLASGIPARFSGSGSGTDYTLTISSL EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 425 |

Figure 3PP: CHA.9.541.7

| What | Sequence | SEQ ID NO: |
|---|---|---|
| Variable heavy (vh) domain | QVQLVQSGAEVKKPGASVKISCKASGYTITNYGMNWVRQAPGQGLEWMGWINTYTGEPTYAQKFQGRFTITLDTSTS TVYLEISSLRSEDTAVYYCARGNGNPLGMDYWGQGTLVTVSS | 426 |
| vhCDR1 | GYTITNYGMN | 427 |
| vhCDR2 | WINTYTGEPT | 428 |
| vhCDR3 | GNGNPLGMDY | 429 |
| Full length HC (IgG4(S241P) CHA.9.541.7.H4(S241P)) | QVQLVQSGAEVKKPGASVKISCKASGYTITNYGMNWVRQAPGQGLEWMGWINTYTGEPTYAQKFQGRFTITLDTSTS TVYLEISSLRSEDTAVYYCARGNGNPLGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 430 |
| Variable light (vl) domain | EIVLTQSPATLSLSPGERATLSCGNGNPLGMDYWYQQKPGQAPRLWIYDTSKLASGVPARFSGSGSGTDYTLTISSL EPEDFAVYYCFQGSGYPLTFGQGTKLEIK | 431 |
| vlCDR1 | GNGNPLGMDY | 432 |
| vlCDR2 | DTSKLAS | 433 |
| vlCDR3 | FQGSGYPLT | 434 |
| Full length light chain (CHA.9.541.7.H4(S241P)) | EIVLTQSPATLSLSPGERATLSCGNGNPLGMDYWYQQKPGQAPRLWIYDTSKLASGVPARFSGSGSGTDYTLTISSL EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 435 |

Figure 3QQ: CHA.9.541.8

| What | Sequence | SEQ ID NO: |
|---|---|---|
| Variable heavy (vh) domain | QVQLVQSGAEVKKPGASVKISCKASGYTITNYGMNWVRQAPGQGLEWMGWINTYTGEPTYAQKFQGRFTITLDTSTS TVYLEISSLRSEDTAVYYCARGNGNPLGMDYWGQGTLVTVSS | 436 |
| vhCDR1 | GYTITNYGMN | 437 |
| vhCDR2 | WINTYTGEPT | 438 |
| vhCDR3 | GNGNPLGMDY | 439 |
| Full length HC (IgG4(S241P); CHA.9.541.8.H4(S241P)) | QVQLVQSGAEVKKPGASVKISCKASGYTITNYGMNWVRQAPGQGLEWMGWINTYTGEPTYAQKFQGRFTITLDTSTS TVYLEISSLRSEDTAVYYCARGNGNPLGMDYWGQGTLVTVSSASTKGPSVFPLAPCSRSTSESTAALGCLVKDYFPEPVTVSW NSGALTSGVHTFPAVLQSSGLYSLSSVVTVPSSSLGTKTYTCNVDHKPSNTKVDKRVESKYGPPCPPCPAPEFLGGPSVFLFPP KPKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYSR LTVDKSRWQEGNVFSCSVMHEALHNHYTQKSLSLSPGK | 440 |
| Variable light (vl) domain | EIVLTQSPATLSLSPGERVTMSCGNGNPLGMDYWYQQKPGQAPRLWIYDTSKLASGVPARFSGSGSGTDYTLTISSM EPEDFAVYYCFQGSGYPLTFGQGTKLEIK | 441 |
| vlCDR1 | GNGNPLGMDY | 442 |
| vlCDR2 | DTSKLAS | 443 |
| vlCDR3 | FQGSGYPLT | 444 |
| Full length light chain (CHA.9.541.8.H4(S241P)) | EIVLTQSPATLSLSPGERVTMSCGNGNPLGMDYWYQQKPGQAPRLWIYDTSKLASGVPARFSGSGSGTDYTLTISSM EPEDFAVYYCFQGSGYPLTFGQGTKLEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 445 |

Figure 3RR: CHA.9.547.10

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYADSVKGRFTISRDNSKN TLYLQMNSLRAEDTAVYYCAKWLLSYYAMDYWGQGTLVTVSS | 446 |
| vhCDR1 | GFTFSSYIMS | 447 |
| vhCDR2 | TISGGGTNTY | 448 |
| vhCDR3 | WLLSYYAMDY | 449 |
| Full length HC for CHA.9.547.10.H4 (S241P) | EVQLVESGGGLVQPGGSLRLSCAASGFTFSSYIMSWVRQAPGKGLEWVSTISGGGTNTYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 450 |
| Variable light (vl) domain | DIQMTQSPSSLSASVGDRVTITCRASQNINVWLSWYQQKPGKAPKLLIYKASKSHTGVPSRFSGSGSGTDFTLTISS LQPEDFATYYCQQGQSYPYTFGQGTKLEIK | 451 |
| vlCDR1 | RASQNINVWLS | 452 |
| vlCDR2 | KASKSHT | 453 |
| vlCDR3 | QQGQSYPYT | 454 |
| Full length light chain For CHA.9.547.10.H4 (S241P) | DIQMTQSPSSLSASVGDRVTITCRASQNINVWLSWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 455 |

Figure 3SS: CHA.9.547.11

| What | Sequence | SEQ ID NO: |
|---|---|---|
| Variable heavy (vh) domain | EVQLVESGGGLVQPGGSLRLSCAASGFTFSSYIMSWVRQAPGKGLEWVSTISGGGTNTYADSVKGRFTISRDNSKN TLYLQMNSLRAEDTAVYYCAKWLLSYYAMDYWGQGTLVTVSS | 456 |
| vhCDR1 | GFTFSSYIMS | 457 |
| vhCDR2 | TISGGGTNTY | 458 |
| vhCDR3 | WLLSYYAMDY | 459 |
| Full length HC for CHA.9.547.11.H4 (S241P)) | EVQLVESGGGLVQPGGSLRLSCAASGFTFSSYIMSWVRQAPGKGLEWVSTISGGGTNTYADSVKGRFTISRDNSKN TLYLQMNSLRAEDTAVYYCAKWLLSYYAMDYWGQGTLVTVSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 460 |
| Variable light (vl) domain | DIQMTQSPSSLSASVGDRITITCRASQNINVWLSWYQQKPGKAPKLLIYKASKSHTGVPSRFSGSGSGTDFTLTISS LQPEDFATYYCQQGQSYPYTFGQGTKLEIK | 461 |
| vlCDR1 | RASQNINVWLS | 462 |
| vlCDR2 | KASKSHT | 463 |
| vlCDR3 | QQGQSYPYT | 464 |
| Full length light chain For CHA.9.547.11.H4 (S241P)) | DIQMTQSPSSLSASVGDRITITCRASQNINVWLSWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 465 |

Figure 3TT: CHA.9.547.12

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYADSVKGRFTISRDNSKN TLYLQMNSLRAEDTAVYYCAKWLLSYYAMDYWGQGTLVTVSS | 466 |
| vhCDR1 | GFTFSSYIMS | 467 |
| vhCDR2 | TISGGGTNTY | 468 |
| vhCDR3 | WLLSYYAMDY | 469 |
| Full length HC For CHA.9.547.12.H4 (S241P)) | EVQLVESGGGLVQPGGSLRLSCAASGFTFSSYIMSWVRQAPGKGLEWVATISGGGTNTYADSVKGRFTISRDNSKN TLYLQMNSLRAEDTAVYYCAKWLLSYYAMDYWGQGTLVTSSASTKGPSVFPLAPCSRSTSESTAALGCLVKDYFPEPVTVS WNSGALTSGVHTFPAVLQSSGLYSLSSVVTVPSSSLGTKTYTCNVDHKPSNTKVDKRVESKYGPPCPAPEFLGGPSVFLF PPKPKDTLMISRTPEVTCVVVDVSQEDPEVQFNWYVDGVEVHNAKTKPREEQFNSTYRVVSVLTVLHQDWLNGKEYKCKV SNKGLPSSIEKTISKAKGQPREPQVYTLPPSQEEMTKNQVSLTCLVKGFYPSDIAVEWESNGQPENNYKTTPPVLDSDGSFFLY SRLTVDKSRWQEGNVFSCSVMHEALHNHYTQKSLSLSPGK | 470 |
| Variable light (vl) domain | DIQMTQSPSSLSASVGDRVTITCRASQNINVWLSWYQQKPGKAPKLLIYKASKSHTGVPSRFSGSGSGTDFTLTISS LQPEDFATYYCQQGQSYPYTFGQGTKLEIK | 471 |
| vlCDR1 | RASQNINVWLS | 472 |
| vlCDR2 | KASKSHT | 473 |
| vlCDR3 | QQGQSYPYT | 474 |
| Full length light chain for CHA.9.547.12.H4 (S241P)) | DIQMTQSPSSLSASVGDRVTITCRASQNINVWLSWYQQKPGKAPKLLIYKASKSHTGVPSRFSGSGSGTDFTLTISS LQPEDFATYYCQQGQSYPYTFGQGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 475 |

Figure 3UU: CHA.9.547.13

| What | Sequence | SEQ ID NO: |
|---|---|---|
| Variable heavy (vh) domain | EVQLVESGGGLVQPGGSLRLSCAASGFTFSSYIMSWVRQAPGKGLEWVATISGGGTNTYADSVKGRFTISRDNSKNTLYLQMNSLRAEDTAVYYCAKWLLSYYAMDYWGQGTLVTVSS | 476 |
| vhCDR1 | GFTFSSYIMS | 477 |
| vhCDR2 | TISGGGTNTY | 478 |
| vhCDR3 | WLLSYYAMDY | 479 |
| Full length HC for CHA.9.547.13.H4 (S241P) | EVQLVESGGGLVQPGGSLRLSCAASGFTFSSYIMSWVRQAPGKGLEWVATISGGGTNTYADSVKGRFTISRDNSKNTLYLQMNSLRAEDTAVYYCAKWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 480 |
| Variable light (vl) domain | DIQMTQSPSSLSASVGDRITITCRASQNINVWLSWYQQKPGKAPKLLIYKASKSHTGVPSRFSGSGSGTDFTLTISSLQPEDFATYYCQQGQSYPYTFGQGTKLEIK | 481 |
| vlCDR1 | RASQNINVWLS | 482 |
| vlCDR2 | KASKSHT | 483 |
| vlCDR3 | QQGQSYPYT | 484 |
| Full length light chain for CHA.9.547.13.H4 (S241P) | DIQMTQSPSSLSASVGDRITITCRASQNINVWLSWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 485 |

Figure 3VV: CHA.9.543

| What | Sequence | SEQ ID NO: |
|---|---|---|
| Variable heavy (vh) domain | EVQLQQSGPELVKPGASMKISCKASGYSFTGYTMNWVRQSHGKNLEWLGLIFPYNGGTSYNQNFKGKATLTVDTSSSTAY MELLSLTSVDSAVYYCARGVRFALDYWGQGTSVSVSS | 486 |
| vhCDR1 | GYSFTGYTMN | 487 |
| vhCDR2 | LIFPYNGGTS | 488 |
| vhCDR3 | GVRFALDY | 489 |
| Full length HC for CHA.9.543.H4(S2 41P)) | Mouse hybridoma, sequence not available | |
| Variable light (vl) domain | DVVMTQTPLSLPVSFGDQVSISCRSSQSLANSYGNTYLSWYLHKPGQSPQLLIYEISNRFSGVPDRFSGSGSGTDFTLNISTIKP EDLGMYYCLQGTHQPWTFGGGTKLEIK | 490 |
| vlCDR1 | RSSQSLANSYGNTYLS | 491 |
| vlCDR2 | EISNRFS | 492 |
| vlCDR3 | LQGTHQPWT | 493 |
| Full length light chain for CHA.9.543.H4(S2 41P)) | Mouse hybridoma, sequence not available | |

Figure 3WW: BM26 mouse IgG1 (BM26-M1) (WO2016/028656A1, Clone 31C6)

| What | Sequence | SEQ ID NO: |
|---|---|---|
| Variable heavy (vh) domain | EVQLQQSGPELVKPGSSVKMSCKASGYTFSSYVMHWVKQKPGQGLEWIGYIDPYNDGAKYNEKFKGKATLTSDKSSSTAY MELSSLTSEDSAVYYCARGGPYGWYFDVWGAGTTVTVSS | 494 |
| vhCDR1 | GYTFSSYV | 495 |
| vhCDR2 | IDPYNDGA | 496 |
| vhCDR3 | ARGGPYGWYFDV | 497 |
| Full length HC | EVQLQQSGPELVKPGSSVKMSCKASGYTFSSYVMHWVKQKPGQGLEWIGYIDPYNDGAKYNEKFKGKATLTSDKSSSTAY MELSSLTSEDSAVYYCARGGPYGWYFDVWGAGTTVTVSSAKTTPPSVYPLAPGSAAQTNSMVTLGCLVKGYFPEPVTVTW NSGSLSSGVHTFPAVLQSDLYTLSSSVTVPSSTWPSETVTCNVAHPASSTKVDKKIVPRDCGCKPCICTVPEVSSVFIFPPKPKD VLTITLTPKVTCVVVDISKDDPEVQFSWFVDDVEVHTAQTQPREEQFNSTFRSVSELPIMHQDWLNGKEFKCRVNSAAFPAP IEKTISKTKGRPKAPQVYTIPPPKEQMAKDKVSLTCMITDFFPEDITVEWQWNGQPAENYKNTQPIMDTDGSYFVYSKLNV QKSNWEAGNTFTCSVLHEGLHNHHTEKSLSHSPGK | 498 |
| Variable light (vl) domain | DIQMTQSPASLSASVGETVTITCRASEHIYSYLSWYQQKQGKSPQLLVYNAKTLAEGVPSRFSGSGSGTQFSLKINSLQPEDFG TYYCQHHFGSPLTFGAGTTLELK | 499 |
| vlCDR1 | EHIYSY | 500 |
| vlCDR2 | NAK | 501 |
| vlCDR3 | QHHFGSPLT | 502 |
| Full length light chain | DIQMTQSPASLSASVGETVTITCRASEHIYSYLSWYQQKQGKSPQLLVYNAKTLAEGVPSRFSGSGSGTQFSLKINSLQPEDFG TYYCQHHFGSPLTFGAGTTLELKRADAAPTVSIFPPSSEQLTSGGASVVCFLNNFYPKDINVKWKIDGSERQNGVLNSWTDQ DSKDSTYSMSSTLTLTKDEYERHNSYTCEATHKTSTSPIVKSFNRNEC | 503 |

Figure 3XX: BM29 mouse IgG1 (BM29-M1) (US2016/0176963A1, Clone 22G2)

| What | sequence | SEQ ID NO: |
|---|---|---|
| Variable heavy (vh) domain | QVHLQESGPGLVKPSETLSLTCTVSGGSVSSGIYYWSWIRQPPGKGLEWIGYIYYSGSTNYNPSLKSRVTISVDTSKNQFSLKLS SVTAADTAVYYCARDYYVSGNYYNVDYFFGVDWGQGTTVTVSS | 504 |
| vhCDR1 | GGSVSSGIYY | 505 |
| vhCDR2 | IYYSGST | 506 |
| vhCDR3 | ARDYYVSGNYYNVDYFFGVDV | 507 |
| Full length HC | QVHLQESGPGLVKPSETLSLTCTVSGGSVSSGIYYWSWIRQPPGKGLEWIGYIYYSGSTNYNPSLKSRVTISVDTSKNQFSLKLS SVTAADTAVYYCARDYYVSGNYYNVDYFFGVDWGQGTTVTVSSAKTPPSVYPLAPGSAAQTNSMVTLGCLVKGYFPEP VTVTWNSGSLSSGVHTFPAVLQSDLYTLSSSVTVPSSTWPSETVTCNVAHPASSTKVDKKIVPRDCGCKPCICTVPEVSSVFIF PPKPKDVLTITLTPKVTCVVVDISKDDPEVQFSWFVDDVEVHTAQTQPREEQFNSTFRSVSELPIMHQDWLNGKEFKCRVNS AAFPAPIEKTISKTKGRPKAPQVYTIPPPKEQMAKDKVSLTCMITDFFPEDITVEWQWNGQPAENYKNTQPIMDTDGSYFVY SKLNVQKSNWEAGNTFTCSVLHEGLHNHHTEKSLSHSPGK | 508 |
| Variable light (vl) domain | EIVLTQSPATLSLSPGERATLSCRASQSVSSYLAWYQQKPGQAPRLLIYDASNRATGIPARFSGSGSGTDFTLTISSLEPEDFAVY YCQQRSNWPPLFTFGPGTKVDIK | 509 |
| vlCDR1 | QSVSSY | 510 |
| vlCDR2 | DAS | 511 |
| vlCDR3 | QQRSNWPPLFT | 512 |
| Full length light chain | EIVLTQSPATLSLSPGERATLSCRASQSVSSYLAWYQQKPGQAPRLLIYDASNRATGIPARFSGSGSGTDFTLTISSLEPEDFAVY YCQQRSNWPPLFTFGPGTKVDIKRADAAPTVSIFPPSSEQLTSGGASVVCFLNNFYPKDINVKWKIDGSERQNGVLNSWTD QDSKDSTYSMSSTLTLTKDEYERHNSYTCEATHKTSTSPIVKSFNRNEC | 513 |

Figure 3YY

From US20170281764 (JN Bioscieces)

| What | sequence | SEQ ID NO: |
|---|---|---|
| Heavy chain (SEQ ID NO:10 from US2017281764) | DVQLVESGGGLVQPGGSRKLSCAASGFTFSNFGMHWVRQAPEKGLEWVAFISSGSSSIYYADTVKGRFTISRDNPKNTLFLQMTSLRSEDTAMYYCARMRLDYYAMDYWGQGTSVTVSS | 514 |
| vhCDR1 (SEQ ID NO:11 from US2017281764) | NFGMH | 515 |
| vhCDR2 (SEQ ID NO:12 from US2017281764) | FISSGSSSIYYADTVKG | 516 |
| vhCDR3 (SEQ ID NO:13 from US2017281764) | MRLDYYAMDY | 517 |
| Light chain (SEQ ID NO:14 from US2017281764) | DVQITQSPSYLAASPGETITNCRASKSISKYLAWYQEKPGKTNKLLIYSGSTLQSGIPSRFSGSGSGTDFTLTISSLEPEDFAMYYCQQHNEYPWTFGGGTKLEIK | 518 |
| vlCDR1 (SEQ ID NO:15 from US2017281764) | RASKSISKYLA | 519 |
| vlCDR2 (SEQ ID NO:16 from US2017281764) | SGSTLQS | 520 |
| vlCDR3 (SEQ ID NO:17 from US2017281764) | QQHNEYPWT | 521 |

Figure 3ZZ

From US20170281764 (IN Biosciences)

| What | sequence | SEQ ID NO: |
|---|---|---|
| Heavy chain (SEQ ID NO:18 from US2017281764) | EVQLQQSGPELVKPGASVKISCKTSGYTFTEYTMHWVKQSHGKNLEWIGGINPNNGGTSYNQKFKGRATLTVDKSSSTAYMELRSLTSDDSAVYYCARPGWYNYAMDYWGQGTSVTVSS | 522 |
| vhCDR1 (SEQ ID NO:19 from US2017281764) | EYTMH | 523 |
| vhCDR2 (SEQ ID NO:20 from US2017281764) | GINPNNGGTSYNQKFKG | 524 |
| vhCDR3 (SEQ ID NO:21 from US2017281764) | PGWYNYAMDY | 525 |
| Light chain (SEQ ID NO:22 from US2017281764) | DIVMTQSHKFMSTSVGDRVNITCKASQGVSTAVAWYQQKPGQSPKLLIYSASYRTGVPDRFTGSGSGTDFTFTISSVQAEDLAVYHCQQHYITPWTFGGGTKLEIK | 526 |
| vlCDR1 (SEQ ID NO:23 from US2017281764) | KASQGVSTAVA | 527 |
| vlCDR2 (SEQ ID NO:24 from US2017281764) | SASYRYT | 528 |
| vlCDR3 (SEQ ID NO:25 from US2017281764) | QQHYITPWT | 529 |

Figure 3AAA

From US20170281764 (JN Biosciences)

| What | sequence | SEQ ID NO: |
|---|---|---|
| Heavy chain (SEQ ID NO:26 from US2017281764) | EVQLVESGGGLVKPGGSLKLSCAASGFAFSDYDMSWVRQTPEKRLEWVAYISDGGYNTYYPDTVKGRFTISRDNAKNTLYLQMSSLKSEDTAIYYCARQILLRYYFDYWGQGTTLTVSS | 530 |
| vhCDR1 (SEQ ID NO:27 from US2017281764) | DYDMS | 531 |
| vhCDR2 (SEQ ID NO:28 from US2017281764) | YISDGGYNTYYPDTVKG | 532 |
| vhCDR3 (SEQ ID NO:29 from US2017281764) | QILLRYYFDY | 533 |
| Light chain (SEQ ID NO:30 from US2017281764) | DIVMSQSPSSLAVSVGEKVTMTCKSSQSLLYSSNQKNYLAWYQQKPGQSPKLLIYWASTRESGVPDRFTGSGSGTDFTLTISSVKAEDLAVYYCQQYHSYPWTFGGGTKLEIK | 534 |
| vlCDR1 (SEQ ID NO:31 from US2017281764) | KSSQSLLYSSNQKNYLA | 535 |
| vlCDR2 (SEQ ID NO:32 from US2017281764) | WASTRES | 536 |
| vlCDR3 (SEQ ID NO:33 from US2017281764) | QQYHSYPWT | 537 |

Figure 3BBB

From US20170281764 (JN Biosciences)

| What | sequence | SEQ ID NO: |
|---|---|---|
| Heavy chain (SEQ ID NO:35 from US2017281764) | EVQLVESGGGLVQPGGSLRLSCAASGFTFSNFGMHWVRQAPGKGLEWVAFISSGSSS IYYADTVKGRFTISRDNAKNSLYLQMNSLRAEDTAVYYCARMRLDYYAMDYWGQ GTMVTVSS | 538 |
| Light chain (SEQ ID NO:37 from US2017281764) | DIQMTQSPSSLSASVGDRVTITCRASKSISKYLAWYQQKPGKAPKLLIYSGSTLQSGV PSRFSGSGSGTDFTLTISSLQPEDFATYYCQQHNEYPWTFGGGTKVEIK | 539 |

From US20170281764 (JN Biosciences)

| What | sequence | SEQ ID NO: |
|---|---|---|
| Heavy chain (SEQ ID NO:34 from US2017281764) | MDSRLNLVFLVLILKGVQCEVQLVESGGGLVQPGGSLRLSCAASGFTFSNFGMHWV RQAPGKGLEWVAFISSGSSSIYYADTVKGRFTISRDNAKNSLYLQMNSLRAEDTAVY YCARMRLDYYAMDYWGQGTMVTVSS | 540 |
| Light chain (SEQ ID NO:36 from US2017281764) | MRFQVQVLGLLLLWISGAQCDIQMTQSPSSLSASVGDRVTITCRASKSISKYLAWYQ QKPGKAPKLLIYSGSTLQSGVPSRFSGSGSGTDFTLTISSLQPEDFATYYCQQHNEYP WTFGGGTKVEIK | 541 |

Figure 3CCC

From WO2015009856 (GENENTECH, INC. and F. HOFFMANN-LA ROCHE AG; see also, WO2016011264)

| What | sequence | SEQ ID NO: |
|---|---|---|
| Heavy chain (SEQ ID NO:15 from WO2015009856) | EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYCARRPLGHNTFDSWGQGTLVTVSS | 542 |
| vhCDR1 (SEQ ID NO:4 from WO2015009856) | GFTFSSFTMH | 543 |
| vhCDR2 (SEQ ID NO:5 from WO2015009856) | FIRSGSGIVFYADAVRG | 544 |
| vhCDR3 (SEQ ID NO:6 from WO2015009856) | RPLGHNTFDS | 545 |
| Light chain (SEQ ID NO:13 from WO2015009856) | DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKR | 546 |
| vlCDR1 (SEQ ID NO:1 from WO2015009856) | KSSQSLYYSGVKENLLA | 547 |
| vlCDR2 (SEQ ID NO:2 from WO2015009856) | ASIRFT | 548 |
| vlCDR3 (SEQ ID NO:3 from WO2015009856) | QQGINNPLT | 549 |

Figure 3DDD

From WO2015009856 (GENENTECH, INC. and F. HOFFMANN-LA ROCHE AG; see also, WO2016011264)

| What | sequence | SEQ ID NO: |
|---|---|---|
| Heavy chain (SEQ ID NO:16 from WO2015009856) | EVQLQQSGPELVKPGTSMKISCKASGYSFTGHLMNWVKQSHGKNLEWIGLIIPYNGGTS YNQKFKGKATLTVDKSSSTAYMELLSLTSDDSAVYFCSRGLRGFYAMDYWGQGTSVT VSS | 550 |
| vhCDR1 (SEQ ID NO:10 from WO2015009856) | GYSFTGHLMN | 551 |
| vhCDR2 (SEQ ID NO:11 from WO2015009856) | LIIPYNGGTSYNQKFKG | 552 |
| vhCDR3 (SEQ ID NO:12 from WO2015009856) | GLRGFYAMDY | 553 |
| Light chain (SEQ ID NO:14 from WO2015009856) | DVVLTQTPLSLSVSFGDQVSISCRSSQSLVNSYGNTFLSWYLHKPGQSPQLLIFGISNRFS GVPDRFSGSGSGTDFTLKISTIKPEDLGMYYCLQGTHQPPTFGPGTKLEVK | 554 |
| vlCDR1 (SEQ ID NO:7 from WO2015009856) | RSSQSLVNSYGNTFLS | 555 |
| vlCDR2 (SEQ ID NO:8 from WO2015009856) | GISNRFS | 556 |
| vlCDR3 (SEQ ID NO:9 from WO2015009856) | LQGTHQPPT | 557 |

Figure 3EEE
From US 9713641 (Table 5, reproduced herein; SEQ ID NOs: are from US 9713641)

Sequences and germlines (GL) of TIGIT ABPs

| Ab | VH GL | CDR-H1[1] (SEQ ID NOS 558-562) | CDR-H2[2] (SEQ ID NOS 563-567) | CDR-H3[3] (SEQ ID NOS 568-572) | VH Protein (SEQ ID NOS 573-577) | VL GL | CDR-L1[4] (SEQ ID NOS 578-582) | CDR-L2[5] (SEQ ID NOS 583-587) | CDR-L3[6] (SEQ ID NOS 588-592) | VL Protein (SEQ ID NOS 593-597) |
|---|---|---|---|---|---|---|---|---|---|---|
| MAB1 -IgG4 | VH 4-39 | GSITSSS YYWG (SEQ ID NO 48) | SIYYSG ATFYN PSLKS (SEQ ID NO 36) | ARDAN YYGSA WAFDP (SEQ ID NO 29) | QLQLQESGPGLVKPSETLSLTCTVSG GSITSSSYYWGWIRQPPGKGLEWIGSI YYSGATFYNPSLKSRVTISVDTSKNQ FSLKLSSVTAADTAVYYCARDANYY GSAWAFDPWGQGTLVTVSS (SEQ ID NO 4) | VK3-11 | RASQS VSSYL A (SEQ ID NO 70) | DASNRA T (SEQ ID NO 67) | QQHFNL PT (SEQ ID NO 63) | EIVLTQSPATLSLSPGERATLSCRASQSVSSYLAWYQQK PGQAPRLLIYDASNRATGIPARFSGSGSGTDFTLTISSLEP EDFAVYYCQQHFNLPTFGGGTKVEIK (SEQ ID NO 25) |
| MAB2 -IgG4 | VH 4-39 | GSISSSK YYWG (SEQ ID NO 49) | SIYYSG STFYN PSLKS (SEQ ID NO 37) | ARDAN YYGSA WAFDP (SEQ ID NO 29) | QLQLQESGPGLVKPSETLSLTCTVS GGSISSSKYYWGWIRQPPGKGLEWI GSIYYSGSTFYNPSLKSRVTISVDTS KNQFSLKLSSVTAADTAVYYCARD ANYYGSAWAFDPWGQGTLVTVSS (SEQ ID NO 5) | VK3-11 | RASQS VSSYL A (SEQ ID NO 70) | DASNRA T (SEQ ID NO 67) | QQHFNL PT (SEQ ID NO 63) | EIVLTQSPATLSLSPGERATLSCRASQSVSSYLAWYQQK PGQAPRLLIYDASNRATGIPARFSGSGSGTDFTLTISSLEP EDFAVYYCQQHFNLPTFGGGTKVEIK (SEQ ID NO 25) |
| MAB3 -IgG4 | VH 4-39 | GSISSTS HYWG (SEQ ID NO 50) | SIYYSG STFYNP SLKS (SEQ ID NO 37) | ARDAN YYGSA WAFDP (SEQ ID NO 29) | QLQLQESGPGLVKPSETLSLTCTVS GGSISSTSHYWGWIRQPPGKGLEWI GSIYYSGSTFYNPSLKSRVTISVDTS KNQFSLKLSSVTAADTAVYYCARD ANYYGSAWAFDPWGQGTLVTVSS (SEQ ID NO 6) | VK3-11 | RASQS VSSYL A (SEQ ID NO 70) | DASNRA T (SEQ ID NO 67) | QQHFNL PT (SEQ ID NO 63) | EIVLTQSPATLSLSPGERATLSCRASQSVSSYLAWYQQK PGQAPRLLIYDASNRATGIPARFSGSGSGTDFTLTISSLEP EDFAVYYCQQHFNLPTFGGGTKVEIK (SEQ ID NO 25) |
| MAB4 -IgG4 | VH 4-39 | GSISSTSH YWG (SEQ ID NO 50) | SIYYSG STFYNP SLKS (SEQ ID NO 37) | ARDAN YYGGA WAFDP (SEQ ID NO 30) | QLQLQESGPGLVKPSETLSLTCTVS GGSISSTSHYWGWIRQPPGKGLEWI GSIYYSGSTFYNPSLKSRVTISVDTS KNQFSLKLSSVTAADTAVYYCARD ANYYGGAWAFDPWGQGTLVTVSS (SEQ ID NO 7) | VK3-11 | RASQS VSSYL A (SEQ ID NO 70) | DASNRA T (SEQ ID NO 67) | QQHFNL PT (SEQ ID NO 63) | EIVLTQSPATLSLSPGERATLSCRASQSVSSYLAWYQQK PGQAPRLLIYDASNRATGIPARFSGSGSGTDFTLTISSLEP EDFAVYYCQQHFNLPTFGGGTKVEIK (SEQ ID NO 25) |
| MARS -IgG4 | VH 4-39 | GSISSTSH YWG (SEQ ID NO 50) | SIYYSG STFYN PSLKG (SEQ ID NO 38) | ARDAN YYGSA WAFDP (SEQ ID NO 29) | QLQLQESGPGLVKPSETLSLTCTVS GGSISSTSHYWGWIRQPPGKGLEWI GSIYYSGSTFYNPSLKGRVTISVDTS KNQFSLKLSSVTAADTAVYYCARD ANYYGSAWAFDPWGQGTLVTVSS (SEQ ID NO 8) | VK3-11 | RASQS VSSYL A (SEQ ID NO 70) | DASNRA T (SEQ ID NO 67) | QQHFNL PT (SEQ ID NO 63) | EIVLTQSPATLSLSPGERATLSCRASQSVSSYLAWYQQK PGQAPRLLIYDASNRATGIPARFSGSGSGTDFTLTISSLEP EDFAVYYCQQHFNLPTFGGGTKVEIK (SEQ ID NO 25) |

[1] Includes CDR-H1 as defined by both the Chothia and Kabat numbering systems, inclusive of the boundaries of both numbering systems.
[2] According to the Kabat numbering system.
[3] According to the IMGT numbering system.
[4] According to the Kabat and Chothia numbering systems.
[5] According to the Kabat and Chothia numbering systems.
[6] According to the Kabat, Chothia, and IMGT numbering systems.

Figure 3FFF
From US 9713641 (Table 5, reproduced herein; SEQ ID NOs: are from US 9713641)

| Ab | VH GL | | CDR-H1[7] (SEQ ID NOS 598-602) | CDR-H2[8] (SEQ ID NOS 603-607) | CDR-H3[9] (SEQ ID NOS 608-612) | VH Protein (SEQ ID NOS 613-617) | VL GL | CDR-L1[10] (SEQ ID NOS 618-622) | CDR-L2[11] (SEQ ID NOS 623-627) | CDR-L3[12] (SEQ ID NOS 628-632) | VL Protein (SEQ ID NOS 633-637) |
|---|---|---|---|---|---|---|---|---|---|---|---|
| MAB6-IgG4 | VH 4-39 | | GSIESGS YYWG (SEQ ID NO 51) | SIYYSGGT YNPSLK S (SEQ ID NO 39) | ARDGV LTLNKR SFDI (SEQ ID NO 31) | QLQLQESGPGLVKPSETLSLTCTVSG GSIESGSYYWGWIRQPPGKGLEWIG SIYYSGGTYYNPSLKSRVTISVDTSK NQFSLKLSSVTAADTAVYYCARDGV LTLNKRSFDIWGQGTMVTVSS (SEQ ID NO 9) | VK3-20 | RASQS VSSSY LA (SEQ ID NO 71) | GASSRA T (SEQ ID NO 68) | QQHTV RPPLT (SEQ ID NO 64) | EIVLTQSPGTLSLSPGERATLSCRASQSVSSSYLAWYQQ KPGQAPRLLIYGASSRATGIPDRFSGSGSGTDFTLTISRL EPEDFAVYYCQQHTVRPPLTFGGGTKVEIK (SEQ ID NO 26) |
| MAB7-IgG4 | VH 4-31 | | GSIESGV YYWG (SEQ ID NO 52) | SIYYSGST YNPSLK S (SEQ ID NO 40) | ARDGV LTLNKR SFDI (SEQ ID NO 31) | QVQLQESGPGLVKPSQTLSLTCTVSG GSIESGVYYWGWIRQPPGKGLEWIG SIYYSGSTYYNPSLKSRVTISVDTSK NQFSLKLSSVTAADTAVYYCARDGV LTLNKRSFDIWGQGTMVTVSS (SEQ ID NO 10) | VK3-20 | RASQS VSSSY LA (SEQ ID NO 71) | GASSRA T (SEQ ID NO 68) | QQHTV RPPLT (SEQ ID NO 64) | EIVLTQSPGTLSLSPGERATLSCRASQVSSSYLAWYQQ KPGQAPRLLIYGASSRATGIPDRFSGSGSGTDFTLTISRL EPEDFAVYYCQQHTVRPPLTFGGGTKVEIK (SEQ ID NO 26) |
| MAB8-IgG4 | VH 4-39 | | GSIASGS YYWG (SEQ ID NO 53) | SIYYSGQT YNPSLK S (SEQ ID NO 41) | ARDGV LTLNKR SFDI (SEQ ID NO 31) | QLQLQESGPGLVKPSETLSLTCTVSG GSIASGSYYWGWIRQPPGKGLEWIG SIYYSGQTYYNPSLKSRVTISVDTSK NQFSLKLSSVTAADTAVYYCARDG VLTLNKRSFDIWGQGTMVTVSS (SEQ ID NO 11) | VK3-20 | RASQS VSSSY LA (SEQ ID NO 71) | GASSRA T (SEQ ID NO 68) | QQHTV RPPLT (SEQ ID NO 64) | EIVLTQSPGTLSLSPGERATLSCRASQSVSSSYLAWYQQ KPGQAPRLLIYGASSRATGIPDRFSGSGSGTDFTLTISRL EPEDFAVYYCQQHTVRPPLTFGGGTKVEIK (SEQ ID NO 26) |
| MAB9-IgG4 | VH 4-31 | | GSIESGL YYWG (SEQ ID NO 54) | SIYYSGSTY YNPSLKS (SEQ ID NO 40) | ARDGV LTLNKR SFDI (SEQ ID NO 31) | QVQLQESGPGLVKPSQTLSLTCTVS GGSIESGLYYWGWIRQPPGKGLEWI GSIYYSGSTYYNPSLKSRVTISVDTS KNQFSLKLSSVTAADTAVYYCARD GVLTLNKRSFDIWGQGTMVTVSS (SEQ ID NO 12) | VK3-20 | RASQSV SSSYLA (SEQ ID NO 71) | GASSRA T (SEQ ID NO 68) | QQHTV RPPLT (SEQ ID NO 64) | EIVLTQSPGTLSLSPGERATLSCRASQSVSSSYLAWYQQ KPGQAPRLLIYGASSRATGIPDRFSGSGSGTDFTLTISRL EPEDFAVYYCQQHTVRPPLTFGGGTKVEIK (SEQ ID NO 26) |
| MAB10-IgG4 | VH 4-31 | | GSIESGL YYWG (SEQ ID NO 54) | SIYYSGSTY YNPSLKS (SEQ ID NO 40) | ARDGV LALNKR SFDI (SEQ ID NO 32) | QVQLQESGPGLVKPSQTLSLTCTVS GGSIESGLYYWGWIRQPPGKGLEWI GSIYYSGSTYYNPSLKSRATISVDTS KNQFSLKLSSVTAADTAVYYCARD GVLALNKRSFDIWGQGTMVTVSS (SEQ ID NO 13) | VK3-20 | RASQS VSSSY LA (SEQ ID NO 71) | GASSRA T (SEQ ID NO 68) | QQHTV RPPLT (SEQ ID NO 64) | EIVLTQSPGTLSLSPGERATLSCRASQSVSSSYLAWYQQ KPGQAPRLLIYGASSRATGIPDRFSGSGSGTDFTLTISRL EPEDFAVYYCQQHTVRPPLTFGGGTKVEIK (SEQ ID NO 26) |

[7] Includes CDR-H1 as defined by both the Chothia and Kabat numbering systems, inclusive of the boundaries of both numbering systems.
[8] According to the Kabat numbering system.
[9] According to the IMGT numbering system.
[10] According to the Kabat and Chothia numbering systems.
[11] According to the Kabat and Chothia numbering systems.
[12] According to the Kabat, Chothia, and IMGT numbering systems.

Figure 3GGG
From US 9713641 (Table 5, reproduced herein; SEQ ID NOs: are from US 9713641)

Sequences and germlines (GL) of TIGIT ABPs

| Ab | VH GL | CDR-H1[13] (SEQ ID NOS 638-642) | CDR-H2[14] (SEQ ID NOS 643-647) | CDR-H3[15] (SEQ ID NOS 648-652) | VH Protein (SEQ ID NOS 653-657) | VL GL | CDR-L1[16] (SEQ ID NOS 658-662) | CDR-L2[17] (SEQ ID NOS 663-667) | CDR-L3[18] (SEQ ID NOS 668-672) | VL Protein (SEQ ID NOS 673-677) |
|---|---|---|---|---|---|---|---|---|---|---|
| MAB1 1-IgG4 | VH 4-31 | GSIESGLY YWG (SEQ ID NO 54) | SIYYSG STYYNP SLKS (SEQ ID NO 40) | ARDGVL ALNKRS FDI (SEQ ID NO 32) | QVQLQESGPGLVKPSQTLSLTCTVS GGSIESGLYYWGWIRQPPGKGLEWI GSIYYSGSTYYNPSLKSRVTISVDTS KNQFSLKLSSVTAADTAVYYCARD GVLALNKRSFDIWGQGTMVTVSS (SEQ ID NO 14) | VK3-20 | RASQS VSSSY LA (SEQ ID NO 71) | GASSRA T (SEQ ID NO 68) | QQHTVR PPLT (SEQ ID NO 64) | EIVLTQSPGTLSLSPGERATLSCRASQSVSSSYLAWYQQ KPGQAPRLLIYGASSRATGIPDRFSGSGSGTDFTLTISRLE PEDFAVYYCQQHTVRPPLTFGGGTKVEIK (SEQ ID NO 26) |
| MAB1 2-IgG4 | VH 4-31 | GSIESGLY YWG (SEQ ID NO 54) | SIYYSG STYYNP SLKS (SEQ ID NO 40) | ARDGVL ALNKRS FDI (SEQ ID NO 32) | QVQLQESGPGLVKPSQTLSLTCTAS GGSIESGLYYWGWIRQPPGKGLEWI GSIYYSGSTYYNPSLKSRVTISVDTS KNQFSLKLSSVTAADTAVYYCARD GVLALNKRSFDIWGQGTMVTVSS (SEQ ID NO 15) | VK3-20 | RASQS VSSSY LA (SEQ ID NO 71) | GASSRA T (SEQ ID NO 68) | QQHTVR PPLT (SEQ ID NO 64) | EIVLTQSPGTLSLSPGERATLSCRASQSVSSSYLAWYQQ KPGQAPRLLIYGASSRATGIPDRFSGSGSGTDFTLTISRLE PEDFAVYYCQQHTVRPPLTFGGGTKVEIK (SEQ ID NO 26) |
| MAB1 3-IgG4 | VH 1-46 | YTFGNY YMH (SEQ ID NO 58) | IINPSLG LTSYAQ KFQG (SEQ ID NO 42) | ARGGRT TWIGAF DI (SEQ ID NO 33) | QVQLVQSGAEVKKPGASVKVSCKA SGYTFGNYYMHWVRQAPGQGLEW MGIINPSLGLTSYAQKFQGRVTMTR DTSTSTVYMELSSLRSEDTAVYYCA RGGRTTWIGAFDIWGQGTMVTVSS (SEQ ID NO 16) | VK3-15 | RASQS VSSNL A (SEQ ID NO 72) | GASTRA T (SEQ ID NO 69) | QQYVV WPPLT (SEQ ID NO 65) | EIVMTQSPATISVSPGERATLSCRASQSVSSNLAWYQQK PGQAPRLLIYGASTRATGIPARFSGSGSGTEFTLTISSLQS EDFAVYYCQQYVVWPPLTFGGGTKVEIK (SEQ ID NO 27) |
| MAB1 4-IgG4 | VH 1-46 | YTFPAY YMH (SEQ ID NO 59) | IINPSLG LTSYAQ KFQG (SEQ ID NO 42) | ARGGRT TWIGAF DI (SEQ ID NO 33) | QVQLVQSGAEVKKPGASVKVSCKA SGYTFPAYYMHWVRQAPGQGLEW MGIINPSLGLTSYAQKFQGRVTMTR DTSTSTVYMELSSLRSEDTAVYYCA RGGRTTWIGAFDIWGQGTMVTVSS (SEQ ID NO 17) | VK3-15 | RASQS VSSNL A (SEQ ID NO 72) | GASTRA T (SEQ ID NO 69) | QQYVV WPPLT (SEQ ID NO 65) | EIVMTQSPATLSVSPGERATLSCRASQSVSSNLAWYQQK PGQAPRLLIYGASTRATGIPARFSGSGSGTEFTLTISSLQS EDFAVYYCQQYVVWPPLTFGGGTKVEIK (SEQ ID NO 27) |
| MAB1 5-IgG4 | VH 1-46 | YTFREY YMH (SEQ ID NO 60) | IINPSIG LTSYA RKFQG (SEQ ID NO 43) | ARGGRT TWIGAF DI (SEQ ID NO 33) | QVQLVQSGAEVKKPGASVKVSCKA SGYTFREYYMHWVRQAPGQGLEW MGIINPSIGLTSYARKFQGRVTMTR DTSTSTVYMELSSLRSEDTAVYYCA RGGRTTWIGAFDIWGQGTMVTVSS (SEQ ID NO 18) | VK3-15 | RASQS VSSNL A (SEQ ID NO 72) | GASTRA T (SEQ ID NO 69) | QQYVV WPPLT (SEQ ID NO 65) | EIVMTQSPATLSVSPGERATLSCRASQSVSSNLAWYQQK PGQAPRLLIYGASTRATGIPARFSGSGSGTEFTLTISSLQS EDFAVYYCQQYVVWPPLTFGGGTKVEIK (SEQ ID NO 27) |

[13] Includes CDR-H1 as defined by both the Chothia and Kabat numbering systems, inclusive of the boundaries of both numbering systems.
[14] According to the Kabat numbering system.
[15] According to the IMGT numbering system.
[16] According to the Kabat and Chothia numbering systems.
[17] According to the Kabat and Chothia numbering systems.
[18] According to the Kabat, Chothia, and IMGT numbering systems.

Figure 3HHHH
From US 9713641 (Table 5, reproduced herein; SEQ ID NOs: are from US 9713641)

| Ab | VH GL | CDR-H1[19] (SEQ ID NOS 678-683) | CDR-H2[20] (SEQ ID NOS 684-689) | CDR-H3[21] (SEQ ID NOS 690-695) | VH Protein (SEQ ID NOS 696-701) | V L G L | CDR-L1[22] (SEQ ID NOS 702-707) | CDR-L2[23] (SEQ ID NOS 708-713) | CDR-L3[24] (SEQ ID NOS 714-719) | VL Protein (SEQ ID NOS 720-725) |
|---|---|---|---|---|---|---|---|---|---|---|
| MAB1 6-IgG4 | VH 1-46 | YTFRE YYMH (SEQ ID NO 60) | IINPSIGL TSYARK FQG (SEQ ID NO 43) | ARGGRT TWIGAL DI (SEQ ID NO 34) | QVQLVQSGAEVKKPGASVKVSCKASGYT FREYYMHWVRQAPGQGLEWMGIINPSIGL TSYARKFQGRVTMTRDTSTSTVYMELSSL RSEDTAVYYCARGGRTTWIGALDIWGQGT MVTVSS (SEQ ID NO 19) | VLGL3-15 | RASQSV SSNLA (SEQ ID NO 72) | GASTRA T (SEQ ID NO 69) | QQYVVW PPLT (SEQ ID NO 65) | EIVMTQSPATLSVSPGERATLSCRASQSVSSNLAWYQQKPG QAPRLLIYGASTRATGIPARFSGSGSGTEFTLTISSLQSEDFAV YYCQQYVVWPPLTFGGGTKVEIK (SEQ ID NO 27) |
| MAB1 7-IgG4 | VH 1-46 | YTFPA YYIH (SEQ ID NO 61) | IINPSLG LTSYAR KFQG (SEQ ID NO 44) | ARGGRT TWIGAL DI (SEQ ID NO 34) | QVQLVQSGAEVKKPGASVKVSCKASGYT FPAYYIHWVRQAPGQGLEWMGIINPSLGL TSYARKFQGRVTMTRDTSTSTVYMELSSL RSEDTAVYYCARGGRTTWIGALDIWGQG TMVTVSS (SEQ ID NO 20) | VLGL3-15 | RASQSV SSNLA (SEQ ID NO 72) | GASTRA T (SEQ ID NO 69) | QQYVVW PPLT (SEQ ID NO 65) | EIVMTQSPATLSVSPGERATLSCRASQSVSSNLAWYQQKPG QAPRLLIYGASTRATGIPARFSGSGSGTEFTLTISSLQSEDFAV YYCQQYVVWPPLTFGGGTKVEIK (SEQ ID NO 27) |
| MAB1 8-IgG4 | VH 1-46 | YTFPA YYMH (SEQ ID NO 59) | IINPSLGL TSYARKF QG (SEQ ID NO 44) | ARGGRTT WIGAFDI (SEQ ID NO 33) | QVQLVQSGAEVKKPGASVKVSCKASGYT FPAYYMHWVRQAPGQGLEWMGIINPSLG LTSYARKFQGRVTMTRDTSTSTVYMELSS LRSEDTAVYYCARGGRTTWIGAFDIWGQ GTMVTVSS (SEQ ID NO 21) | VLGL3-15 | RASQSV SSNLA (SEQ ID NO 72) | GASTRA T (SEQ ID NO 69) | QQYVVW PPLT (SEQ ID NO 65) | EIVMTQSPATLSVSPGERATLSCRASQSVSSNLAWYQQKPG QAPRLLIYGASTRATGIPARFSGSGSGTEFTLTISSLQSEDFAV YYCQQYVVWPPLTFGGGTKVEIK (SEQ ID NO 27) |
| MAB1 9-IgG4 | VH 1-46 | YTFTS HYMG (SEQ ID NO 62) | VINPSM GATSYA QKFQG (SEQ ID NO 45) | ARLHVS GSYYPA YLDY (SEQ ID NO 35) | QVQLVQSGAEVKKPGASVKVSCKASGYT FTSHYMGWVRQAPGQGLEWMGVINPSM GATSYAQKFQGRVTMTRDTSTLSTVYME LSSLRSEDTAVYYCARLHVSGSYYPAYLD YWGQGTMVTVSS (SEQ ID NO 22) | VLGL3-15 | RASQSV SSNLA (SEQ ID NO 72) | GASTRA T (SEQ ID NO 69) | QQYIVFP WT (SEQ ID NO 66) | EIVMTQSPATLSVSPGERATLSCRASQSVSSNLAWYQQKPG QAPRHLIYGASTRATGIPARFSGSGSGTEFTLTISSLQSEDFA VYYCQQYIVFPWTFGGGTKVEIK (SEQ ID NO 28) |
| MAB2 0-IgG4 | VH 1-46 | YTFTSH YMG (SEQ ID NO 62) | IINPSMG ATSYAQ KFQG (SEQ ID NO 45) | ARLHVS GSYYPA YLDY (SEQ ID NO 35) | QVQLVQSGAEVKKPGASVKVSCKASGYTF TSHYMGWVRQAPGQGLEWVGIINPSMGAT SYAQKFQGRVTMTRDTSTSTVYMELSSLAS EDTAVYYCARLHVSGSYYPAYLDYWGQG TMVTVSS (SEQ ID NO 23) | VLGL3-15 | RASQSV SSNLA (SEQ ID NO 72) | GASTRA T (SEQ ID NO 69) | QQYIVFP WT (SEQ ID NO 66) | EIVMTQSPATLSVSPGERATLSCRASQSVSSNLAWYQQKPG QAPRHLIYGASTRATGIPARFSGSGSGTEFTLTISSLQSEDFA VYYCQQYIVFPWTFGGGTKVEIK (SEQ ID NO 28) |
| MAB2 1-IgG4 | VH 1-46 | YTFTSH YMG (SEQ ID NO 62) | IINPSMG ATSYTQ KFRG (SEQ ID NO 47) | ARLHVS GSYYPA YLDY (SEQ ID NO 35) | QVQLVQSGAEVKKPGASVKVSCKASGYTF TSHYMGWVRQAPGQGLEWMGIINPSMGA TSYTQKFRGRVTMTRDTSTSTVYMELSSLA SEDTAVYYCARLHVSGSYYPAYLDYWGQ GTMVTVSS (SEQ ID NO 24) | VLGL3-15 | RASQSV SSNLA (SEQ ID NO 72) | GASTRA T (SEQ ID NO 69) | QQYIVFP WT (SEQ ID NO 66) | EIVMTQSPATLSVSPGERATLSCRASQSVSSNLAWYQQKPG QAPRHLIYGASTRATGIPARFSGSGSGTEFTLTISSLQSEDFA VYYCQQYIVFPWTFGGGTKVEIK (SEQ ID NO 28) |

[19] Includes CDR-H1 as defined by both the Chothia and Kabat numbering systems, inclusive of the boundaries of both numbering systems.
[20] According to the Kabat numbering system.
[21] According to the IMGT numbering system.
[22] According to the Kabat and Chothia numbering systems.
[23] According to the Kabat and Chothia numbering systems.
[24] According to the Kabat, Chothia, and IMGT numbering systems.

Figure 3III

From WO2016028656 (Table 4, reproduced herein)

| What | sequence | SEQ ID NO: |
|---|---|---|
| Heavy chain (SEQ ID NO:7 from WO2016028656) | EVQLQESGPGLVKPSQSLSLTCSVTGSSIASDYWGWIRKFPGNKMEWMGFITYSGSTSYNPSLKSRISITRDTSKNQFFLQLHSVTTDDTATYSCARMPSFITLASLSTWEGYFDFWGPGTMVTVSS | 726 |
| vhCDR1 (SEQ ID NO:1 from WO2016028656) | SDYWG | 727 |
| vhCDR2 (SEQ ID NO:2 from WO2016028656) | FITYSGSTSYNPSLKS | 728 |
| vhCDR3 (SEQ ID NO:3 from WO2016028656) | MPSFITLASLSTWEGYFDF | 729 |
| Light chain (SEQ ID NO:8 from WO2016028656) | DIQMTQSPSLLSASVGDRVTLNCKASQSIHKNLAWYQQKLGEAPKFLIYYANSLQTGIPSRFSGSGSGTDFTLTISGLQPEDVATYFCQQYYSGWTFGGGTKVELK | 730 |
| vlCDR1 (SEQ ID NO:4 from WO2016028656) | KASQSIHKNLA | 731 |
| vlCDR2 (SEQ ID NO:5 from WO2016028656) | YANSLQT | 732 |
| vlCDR3 (SEQ ID NO:6 from WO2016028656) | QQYYSGWT | 733 |

Figure 3JJJ

| From WO2016028656 (Table 4, reproduced herein) | | |
|---|---|---|
| What | sequence | SEQ ID NO: |
| Heavy chain (SEQ ID NO:9 from WO2016028656) | EVQLQESGPGLVKPSETLSLTCTVSGGSISSDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS | 734 |
| vhCDR1 (WO2016028656) | DYWG | 735 |
| vhCDR2 (WO2016028656) | FITYSGSTSYNPSLKS | 736 |
| vhCDR3 (WO2016028656) | MPSFITLASLSTWEGYFDF | 737 |

| From WO2016028656 (Table 4, reproduced herein) | | |
|---|---|---|
| What | sequence | SEQ ID NO: |
| Heavy chain (SEQ ID NO:10 from WO2016028656) | EVQLQESGPGLVKPSETLSLTCTVSGGSISSDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS | 738 |
| vhCDR1 (from WO2016028656) | SDYWG | 739 |
| vhCDR2 (from WO2016028656) | FITYSGSTSYNPSLKS | 740 |
| vhCDR3 (WO2016028656) | MPSFITLASLSTWEGYFDF | 741 |

Figure 3KKK

| What | sequence | SEQ ID NO: |
|---|---|---|
| From WO2016028656 (Table 4, reproduced herein) | | |
| Heavy chain (SEQ ID NO:11 from WO2016028656) | EVQLQESGPGLVKPSETLSLTCTVSGGSISSDYWGWIRQPPGKGLEWIGFITYSGSTSYNPSLKSRITISRDTSKNQFSLKLSSVTAADTAVYYCARMPSFITLASLSTWEGYFDFWGQGTMVTVSS | 742 |
| vhCDR1 (from WO2016028656) | SDYWG | 743 |
| vhCDR2 (from WO2016028656) | FITYSGSTSYNPSLKS | 744 |
| vhCDR3 (from WO2016028656) | MPSFITLASLSTWEGYFDF | 745 |

| What | sequence | SEQ ID NO: |
|---|---|---|
| From WO2016028656 (Table 4, reproduced herein) | | |
| Heavy chain (SEQ ID NO:12 from WO2016028656) | EVQLQESGPGLVKPSETLSLTCTVSGSSISSDYWGWIRQPPGKGLEWMGFITYSGSTSYNPSLKSRITISRDTSKNQFSLKLSSVTAADTAVYYCARMPSFITLASLSTWEGYFDFWGQGTMVTVSS | 746 |
| vhCDR1 (from WO2016028656) | SDYWG | 747 |
| vhCDR2 (from WO2016028656) | FITYSGSTSYNPSLKS | 748 |
| vhCDR3 (from WO2016028656) | MPSFITLASLSTWEGYFDF | 749 |

Figure 3LLL

| From WO2016028656 (Table 4, reproduced herein) | | |
|---|---|---|
| What | sequence | SEQ ID NO: |
| Heavy chain (SEQ ID NO:13 from WO2016028656) | EVQLQESGPGLVKPSETLSLTCTVSGGSISSDYWGWIRQPPGKGLEWIGFITYSGSTSYNPSLKSRVTISRDTSKNQFSLKLHSVTAADTAVYYCARMPSFITLASLSTWEGYFDFWGQGTMVTVSS | 750 |
| vhCDR1 (from WO2016028656) | SDYWG | 751 |
| vhCDR2 (from WO2016028656) | FITYSGSTSYNPSLKS | 752 |
| vhCDR3 (from WO2016028656) | MPSFITLASLSTWEGYFDF | 753 |

| From WO2016028656 (Table 4, reproduced herein) | | |
|---|---|---|
| What | sequence | SEQ ID NO: |
| Heavy chain (SEQ ID NO:14 from WO2016028656) | EVQLQESGPGLVKPSETLSLTCTVSGGSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS | 754 |
| vhCDR1 (from WO2016028656) | SDYWG | 755 |
| vhCDR2 from WO2016028656) | GFITYSGSTSYNPSLKS | 756 |
| vhCDR3 (from WO2016028656) | MPSFITLASLSTWEGYFDF | 757 |

Figure 3MMM

| What | sequence | SEQ ID NO: |
|---|---|---|
| From WO2016028656 (Table 4, reproduced herein) | | |
| Heavy chain (SEQ ID NO:15 from WO2016028656) | EVQLQESGPGLVKPSETLSLTCTVSGSSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS | 758 |
| vhCDR1 (from WO2016028656) | SDYWG | 759 |
| vhCDR2 (from WO2016028656) | FITYSGSTSYNPSLKS | 760 |
| vhCDR3 (from WO2016028656) | MPSFITLASLSTWEGYFDF | 761 |
| From WO2016028656 (Table 4, reproduced herein) | | SEQ ID NO: |
| Heavy chain (SEQ ID NO:16 from WO2016028656) | EVQLQESGPGLVKPSETLSLTCTVSGSSISSDYWGWIRQPPGKGLEWMGFITYSGSTSYNPSLKSRITISVDTSKNQFSLKLHSVTAADTAVYYCARMPSFITLASLSTWEGYFDFWGQGTMVTVSS | 762 |
| vhCDR1 (from WO2016028656) | SDYWG | 763 |
| vhCDR2 (from WO2016028656) | FITYSGSTSYNPSLKS | 764 |
| vhCDR3 (from WO2016028656) | MPSFITLASLSTWEGYFDF | 765 |

Figure 3NNN

| From WO2016028656 (Table 4, reproduced herein) | | |
|---|---|---|
| What | sequence | SEQ ID NO: |
| Heavy chain (SEQ ID NO:17 from WO2016028656) | EVQLQESGPGLVKPSETLSLTCAVSGYSISSDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS | 766 |
| vhCDR1 (from WO2016028656) | SDYWG | 767 |
| vhCDR2 (from WO2016028656) | FITYSGSTSYNPSLKS | 768 |
| vhCDR3 (from WO2016028656) | MPSFITLASLSTWEGYFDF | 769 |

| From WO2016028656 (Table 4, reproduced herein) | | |
|---|---|---|
| What | sequence | SEQ ID NO: |
| Heavy chain (SEQ ID NO:18 from WO2016028656) | EVQLQESGPGLVKPSETLSLTCAVSGYSISSDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS | 770 |
| vhCDR1 (from WO2016028656) | SDYWG | 771 |
| vhCDR2 (from WO2016028656) | FITYSGSTSYNPSLKS | 772 |
| vhCDR3 (from WO2016028656) | MPSFITLASLSTWEGYFDF | 773 |

Figure 3OOO

| From WO2016028656 (Table 4, reproduced herein) | | |
|---|---|---|
| What | sequence | SEQ ID NO: |
| Heavy chain (SEQ ID NO:19 from WO2016028656) | EVQLQESGPGLVKPSETLSLTCAVSGYSISSDYWGWIRQPPGKGLEWIGFI TYSGSTSYNPSLKSRITISRDTSKNQFSLKLSSVTAADTAVYYCARMPSFI TLASLSTWEGYFDFWGQGTMVTVSS | 774 |
| vhCDR1 (from WO2016028656) | SDYWG | 775 |
| vhCDR2 (from WO2016028656) | FITYSGSTSYNPSLKS | 776 |
| vhCDR3 (from WO2016028656) | MPSFITLASLSTWEGYFDF | 777 |

| From WO2016028656 (Table 4, reproduced herein) | | |
|---|---|---|
| What | sequence | SEQ ID NO: |
| Heavy chain (SEQ ID NO:20 from WO2016028656) | EVQLQESGPGLVKPSETLSLTCAVSGSSISSDYWGWIRQPPGKGLEWMGFI TYSGSTSYNPSLKSRITISRDTSKNQFSLKLSSVTAADTAVYYCARMPSFI TLASLSTWEGYFDFWGQGTMVTVSS | 778 |
| vhCDR1 (from WO2016028656) | SDYWG | 779 |
| vhCDR2 (from WO2016028656) | FITYSGSTSYNPSLKS | 780 |
| vhCDR3 (from WO2016028656) | MPSFITLASLSTWEGYFDF | 781 |

Figure 3PPP

| What | Sequence | SEQ ID NO: |
|---|---|---|
| From WO2016028656 (Table 4, reproduced herein) | | |
| Heavy chain (SEQ ID NO:21 from WO2016028656) | EVQLQESGPGLVKPSETLSLTCAVSGYSISSDYWGWIRQPPGKGLEWIGFITYSGSTSYNPSLKSRVTISRDTSKNQFSLKLHSVTAADTAVYYCARMPSFITLASLSTWEGYFDFWGQGTMVTVSS | 782 |
| vhCDR1 (from WO2016028656) | SDYWG | 783 |
| vhCDR2 (from WO2016028656) | FITYSGSTSYNPSLKS | 784 |
| vhCDR3 (from WO2016028656) | MPSFITLASLSTWEGYFDF | 785 |
| From WO2016028656 (Table 4, reproduced herein) | | SEQ ID NO: |
| Heavy chain (SEQ ID NO:22 from WO2016028656) | EVQLQESGPGLVKPSETLSLTCAVSGYSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS | 786 |
| vhCDR1 (from WO2016028656) | SDYWG | 787 |
| vhCDR2 (from WO2016028656) | FITYSGSTSYNPSLKS | 788 |
| vhCDR3 (from WO2016028656) | MPSFITLASLSTWEGYFDF | 789 |

Figure 3QQQ

| From WO2016028656 (Table 4, reproduced herein) | | |
|---|---|---|
| What | Sequence | SEQ ID NO: |
| Heavy chain (SEQ ID NO:37 from WO2016028656) | EVQLQESGPGLVKPSETLSLTCTVSGSSIASDYWGWIRQPPGKGLEWIGFITYSGSTSYNPSLKSRVTISVDTSKNQFSLKLSSVTAADTAVYYCARMPSFITLASLSTWEGYFDFWGQGTMVTVSSAS | 790 |
| vhCDR1 (from WO2016028656) | SDYWG | 791 |
| vhCDR2 (from WO2016028656) | FITYSGSTSYNPSLKS | 792 |
| vhCDR3 (from WO2016028656) | MPSFITLASLSTWEGYFDF | 793 |

| From WO2016028656 (Table 4, reproduced herein) | | |
|---|---|---|
| What | Sequence | SEQ ID NO: |
| Heavy chain (SEQ ID NO:38 from WO2016028656) | EVQLQESGPGLVKPSETLSLTCTVSGSSIASDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS | 794 |
| vhCDR1 (from WO2016028656) | SDYWG | 795 |
| vhCDR2 (from WO2016028656) | FITYSGSTSYNPSLKS | 796 |
| vhCDR3 (from WO2016028656) | MPSFITLASLSTWEGYFDF | 797 |

Figure 3RRR

From WO2016028656 (Table 4, reproduced herein)

| What | Sequence | SEQ ID NO: |
|---|---|---|
| Heavy chain (SEQ ID NO:39 from WO2016028656) | EVQLQESGPGLVKPSETLSLTCTVSGSSIASDYWGWIRKPPGKGLEWIGFITYSGTSYNPSLKSRVTISRDTSKNQFSLKLSSVTAADTAVYYCARMPSFITLASLSTWEGYFDFWGQGTMVTVSS | 798 |
| vhCDR1 (from WO2016028656) | SDYWG | 799 |
| vhCDR2 (from WO2016028656) | FITYSGTSYNPSLKS | 800 |
| vhCDR3 (from WO2016028656) | MPSFITLASLSTWEGYFDF | 801 |

From WO2016028656 (Table 4, reproduced herein)

| What | Sequence | SEQ ID NO: |
|---|---|---|
| Heavy chain (SEQ ID NO:40 from WO2016028656) | EVQLQESGPGLVKPSETLSLTCTVSGSSIASDYWGWIRQPPGKKLEWIGFITYSGTSYNPSLKSRVTISRDTSKNQFSLKLSSVTAADTAVYYCARMPSFITLASLSTWEGYFDFWGQGTMVTVSS | 802 |
| vhCDR1 (from WO2016028656) | SDYWG | 803 |
| vhCDR2 (from WO2016028656) | FITYSGTSYNPSLKS | 804 |
| vhCDR3 (from WO2016028656) | MPSFITLASLSTWEGYFDF | 805 |

Figure 3SSS

| What | Sequence | SEQ ID NO: |
|---|---|---|
| From WO2016028656 (Table 4, reproduced herein) | | |
| Heavy chain (SEQ ID NO:41 from WO2016028656) | EVQLQESGPGLVKPSETLSLTCTVSGSSIASDYWGWIRQPPGKGMEWIGFITYSGSTSYNPSLKSRVTISRDTSKNQFSLKLSSVTAADTAVYYCARMPSFITLASLSTWEGYFDFWGQGTMVTVSS | 806 |
| vhCDR1 (from WO2016028656) | SDYWG | 807 |
| vhCDR2 (from WO2016028656) | FITYSGSTSYNPSLKS | 808 |
| vhCDR3 (from WO2016028656) | MPSFITLASLSTWEGYFDF | 809 |
| From WO2016028656 (Table 4, reproduced herein) | | SEQ ID NO: |
| Heavy chain (SEQ ID NO:42 from WO2016028656) | EVQLQESGPGLVKPSETLSLTCTVSGSSIASDYWGWIRKPPGKKMEWIGFITYSGSTSYNPSLKSRVTISRDTSKNQFSLKLSSVTAADTAVYYCARMPSFITLASLSTWEGYFDFWGQGTMVTVSS | 810 |
| vhCDR1 (from WO2016028656) | SDYWG | 811 |
| vhCDR2 (from WO2016028656) | FITYSGSTSYNPSLKS | 812 |
| vhCDR3 (from WO2016028656) | MPSFITLASLSTWEGYFDF | 813 |

Figure 3TTT

From WO2016028656 (Table 4, reproduced herein)

| What | Sequence | SEQ ID NO: |
|---|---|---|
| Heavy chain (SEQ ID NO:43 from WO2016028656) | EVQLQESGPGLVKPSETLSLTCTVSGSSIASDYWGWIRQFPGKGLEWIGFITYSGSTSYNPSLKSRVTISRDTSKNQFSLKLSSVTADDTAVYYCARMPSFITLASLSTWEGYFDFWGQGTMVTVSS | 814 |
| vhCDR1 (from WO2016028656) | SDYWG | 815 |
| vhCDR2 (from WO2016028656) | FITYSGSTSYNPSLKS | 816 |
| vhCDR3 (from WO2016028656) | MPSFITLASLSTWEGYFDF | 817 |

From WO2016028656 (Table 4, reproduced herein)

| What | Sequence | SEQ ID NO: |
|---|---|---|
| Heavy chain (SEQ ID NO:44 from WO2016028656) | EVQLQESGPGLVKPSETLSLTCTVSGSSIASDYWGWIRKPPGKKMEWIGFITYSGSTSYNPSLKSRVTISVDTSKNQFSLKLSSVTAADTAVYYCARMPSFITLASLSTWEGYFDFWGQGTMVTVSS | 818 |
| vhCDR1 (from WO2016028656) | SDYWG | 819 |
| vhCDR2 (from WO2016028656) | FITYSGSTSYNPSLKS | 820 |
| vhCDR3 (from WO2016028656) | MPSFITLASLSTWEGYFDF | 821 |

Figure 3UUU

From WO2016028656 (Table 4, reproduced herein)

| What | Sequence | SEQ ID NO: |
|---|---|---|
| Heavy chain (SEQ ID NO:45 from WO2016028656) | EVQLQESGPGLVKPSETLSLTCSVTGSSIASDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS | 822 |
| vhCDR1 (from WO2016028656) | SDYWG | 823 |
| vhCDR2 (from WO2016028656) | FITYSGSTSYNPSLKS | 824 |
| vhCDR3 (from WO2016028656) | MPSFITLASLSTWEGYFDF | 825 |

From WO2016028656 (Table 4, reproduced herein)

| What | Sequence | SEQ ID NO: |
|---|---|---|
| Heavy chain (SEQ ID NO:46 from WO2016028656) | EVQLQQSGAGLLKPSETLSLTCSVTGSSIASDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS | 826 |
| vhCDR1 (from WO2016028656) | SDYWG | 827 |
| vhCDR2 (from WO2016028656) | FITYSGSTSYNPSLKS | 828 |
| vhCDR3 (from WO2016028656) | MPSFITLASLSTWEGYFDF | 829 |

Figure 3VVV

From WO2016028656 (Table 4, reproduced herein)

| What | Sequence | SEQ ID NO: |
|---|---|---|
| Heavy chain (SEQ ID NO:47 from WO2016028656) | EVQLQESGPGLVKPPGTLSLTCSVTGSSIASDYWGWVRQPPGKGLEWIGFITYSGSTSYN PSLKSRVTISVDTSKNQFSLKLSSVTAADTAVYYCARMPSFITLASLSTWEGYFDFWGQ GTMVTVSS | 830 |
| vhCDR1 (from WO2016028656) | SDYWG | 831 |
| vhCDR2 (from WO2016028656) | FITYSGSTSYNPSLKS | 832 |
| vhCDR3 (from WO2016028656) | MPSFITLASLSTWEGYFDF | 833 |

Figure 3WWW

From WO2016028656 (Table 4, reproduced herein)

| What | sequence | SEQ ID NO: |
|---|---|---|
| Heavy chain (SEQ ID NO:23 from WO2016028656) | EVQLQESGPGLVKPSETLSLTCAVSGSSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS | 834 |
| vhCDR1 (SEQ ID NO: from WO2016028656) | SDYWG | 835 |
| vhCDR2 (SEQ ID NO: from WO2016028656) | FITYSGSTSYNPSLKS | 836 |
| vhCDR3 (SEQ ID NO: from WO2016028656) | MPSFITLASLSTWEGYFDF | 837 |

Figure 3XXX
From WO2016028656 (Table 4, reproduced herein)

| What | sequence | SEQ ID NO: |
|---|---|---|
| Heavy chain (SEQ ID NO:24 from WO2016028656) | EVQLQESGPGLVKPSETLSLTCAVSGSSISSDYWGWIRQPPGKGLEWMGFITYSGSTSYNPSLKSRITISRDTSKNQFSLKLHSVTAADTAVYYCARMPSFITLASLSTWEGYFDFWGQGTMVTVSS | 838 |
| vhCDR1 (from WO2016028656) | SDYWG | 839 |
| vhCDR2 (WO2016028656) | FITYSGSTSYNPSLKS | 840 |
| vhCDR3 (WO2016028656) | MPSFITLASLSTWEGYFDF | 841 |

From WO2016028656 (Table 4, reproduced herein)

| What | sequence | SEQ ID NO: |
|---|---|---|
| Light chain (SEQ ID NO:25 from WO2016028656) | DIQMTQSPSSLSASVGDRVTITCKASQSIHKNLAWYQQKPGKAPKLLIYYANSLQTGVPSRFSGSGSGTDFTLTISSLQPEDFATYYCQQYYSGWTFGGGTKVEIK | 842 |
| vlCDR1 (from WO2016028656) | KASQSIHKNLAW | 843 |
| vlCDR2 (from WO2016028656) | YANSLQT | 844 |
| vlCDR3 (from WO2016028656) | QQYYSGWT | 845 |

Figure 3YYY

| From WO2016028656 (Table 4, reproduced herein) | | |
|---|---|---|
| What | sequence | SEQ ID NO: |
| Light chain (SEQ ID NO:26 from WO2016028656) | DIQMTQSPSSLSASVGDRVTITCKASQSIHKNLAWYQQKPGKAPKFLIYYANSLQTGVPS RFSGSGSGTDFTLTISSLQPEDFATYYCQQYYSGWTFGGGTKVEIK | 846 |
| vlCDR1 (from WO2016028656) | KASQSIHKNLAW | 847 |
| vlCDR2 (from WO2016028656) | YANSLQT | 848 |
| vlCDR3 (from WO2016028656) | QQYYSGWT | 849 |

| From WO2016028656 (Table 4, reproduced herein) | | |
|---|---|---|
| What | sequence | SEQ ID NO: |
| Light chain (SEQ ID NO:27 from WO2016028656) | DIQMTQSPSSLSASVGDRVTITCKASQSIHKNLAWYQQKPGKAPKFLIYYANSLQTGIPS RFSGSGSGTDFTLTISSLQPEDFATYYCQQYYSGWTFGGGTKVEIK | 850 |
| vlCDR1 (from WO2016028656) | KASQSIHKNLAW | 851 |
| vlCDR2 (from WO2016028656) | YANSLQT | 852 |
| vlCDR3 (from WO2016028656) | QQYYSGWT | 853 |

Figure 3ZZZ

| From WO2016028656 (Table 4, reproduced herein) | | |
|---|---|---|
| What | sequence | SEQ ID NO: |
| Light chain (SEQ ID NO:28 from WO2016028656) | DIQMTQSPSSLSASVGDRVTITCKASQSIHKNLAWYQQKPGKVPKLLIYYANSLQTGVPSRFSGSGSGTDFTLTISSLQPEDVATYYCQQYYSGWTFGGGTKVEIK | 854 |
| vlCDR1 (from WO2016028656) | KASQSIHKNLAW | 855 |
| vlCDR2 (from WO2016028656) | YANSLQT | 856 |
| vlCDR3 (from WO2016028656) | QQYYSGWT | 857 |

| From WO2016028656 (Table 4, reproduced herein) | | |
|---|---|---|
| What | sequence | SEQ ID NO: |
| Light chain (SEQ ID NO:29 from WO2016028656) | DIQMTQSPSSLSASVGDRVTITCKASQSIHKNLAWYQQKPGKVPKFLIYYANSLQTGVPSRFSGSGSGTDFTLTISSLQPEDVATYYCQQYYSGWTFGGGTKVEIK | 858 |
| vlCDR1 (from WO2016028656) | KASQSIHKNLAW | 859 |
| vlCDR2 (from WO2016028656) | YANSLQT | 860 |
| vlCDR3 (from WO2016028656) | QQYYSGWT | 861 |

Figure 3AAAA

| From WO2016028656 (Table 4, reproduced herein) | | |
|---|---|---|
| What | sequences | SEQ ID NO: |
| Light chain (SEQ ID NO:30 from WO2016028656) | DIQMTQSPSSLSASVGDRVTITCKASQSIHKNLAWYQQKPGKVPKFLIYYANSLQTGIPS RFSGSGSGTDFTLTISSLQPEDVATYYCQQYYSGWTFGGGTKVEIK | 862 |
| vlCDR1 (from WO2016028656) | KASQSIHKNLAW | 863 |
| vlCDR2 (from WO2016028656) | YANSLQT | 864 |
| vlCDR3 (from WO2016028656) | QQYYSGWT | 865 |

| From WO2016028656 (Table 4, reproduced herein) | | |
|---|---|---|
| What | sequence | SEQ ID NO: |
| Light chain (SEQ ID NO:48 from WO2016028656) | DIQMTQSPSSLSASVGDRVTITCKASQSIHKNLAWYQQKPGKAPKLLIYYANSLQTGVP SRFSGSGSGTDFTLTISSLQPEDFATYYCQQYYSGWTFGGGTKVEIK | 866 |
| vlCDR1 (from WO2016028656) | KASQSIHKNLAW | 867 |
| vlCDR2 (WO2016028656) | YANSLQT | 868 |
| vlCDR3 (WO2016028656) | QQYYSGWT | 869 |

Figure 3BBBB

| From WO2016028656 (Table 4, reproduced herein) | | |
|---|---|---|
| What | sequence | SEQ ID NO: |
| Light chain (SEQ ID NO:49 from WO2016028656) | DIQMTQSPSSLSASVGDRVTITCKASQSIHKNLAWYQQKPGKAPKFLIYYANSLQTGVPS RFSGSGSGTDFTLTISSLQPEDFATYYCQQYYSGWTFGGGTKVEIK | 870 |
| vlCDR1 (from WO2016028656) | KASQSIHKNLAW | 871 |
| vlCDR2 (WO2016028656) | YANSLQT | 872 |
| vlCDR3 (WO2016028656) | QQYYSGWT | 873 |

| From WO2016028656 (Table 4, reproduced herein) | | |
|---|---|---|
| What | sequence | SEQ ID NO: |
| Light chain (SEQ ID NO:50 from WO2016028656) | DIQMTQSPSSLSASVGDRVTITCKASQSIHKNLAWYQQKPGKAPKLLIYYANSLQTGVP SRFSGSGSGTDFTLTISSLQPEDFATYFCQQYYSGWTFGGGTKVEIK | 874 |
| vlCDR1 (from WO2016028656) | KASQSIHKNLAW | 875 |
| vlCDR2 (WO2016028656) | YANSLQT | 876 |
| vlCDR3 (WO2016028656) | QQYYSGWT | 877 |

Figure 3CCCC

| From WO2016028656 (Table 4, reproduced herein) | | |
|---|---|---|
| What | sequence | SEQ ID NO: |
| Light chain (SEQ ID NO:51 from WO2016028656) | DIQMTQSPSSLSASVGDRVTITCKASQSIHKNLAWYQQKPGKAPKFLIYYANSLQTGVPS RFSGSGSGTDFTLTISSLQPEDFATYFCQQYYSGWTFGGGTKVEIK | 878 |
| vlCDR1 (from WO2016028656) | KASQSIHKNLAW | 879 |
| vlCDR2 (WO2016028656) | YANSLQT | 880 |
| vlCDR3 (WO2016028656) | QQYYSGWT | 881 |

| From WO2016028656 (Table 4, reproduced herein) | | |
|---|---|---|
| What | sequence | SEQ ID NO: |
| Light chain (SEQ ID NO:52 from WO2016028656) | DIQMTQSPSSLSASVGDRVTITCKASQSIHKNLAWYQQKPGKAPKLLIYYANSLQTGIPS RFSGSGSGTDFTLTISSLQPEDFATYYCQQYYSGWTFGGGTKVEIK | 882 |
| vlCDR1 (from WO2016028656) | KASQSIHKNLAW | 883 |
| vlCDR2 (WO2016028656) | YANSLQT | 884 |
| vlCDR3 (WO2016028656) | QQYYSGWT | 885 |

Figure 3DDDD

From WO2016028656 (Table 4, reproduced herein)

| What | sequence | SEQ ID NO: |
|---|---|---|
| Heavy chain (SEQ ID NO:63 from WO2016028656) | DVQLQESGPGLVKPSQSLSLTCTVTGYSITSDYAWNWIRQFPGNKLEWMGYISNSGSASYNPSLKSRISITRDTSKNQFFLQLNSVTTEDTATYYCATLIYYDYGGAMNFWGQGTSVTVSS | 886 |
| vhCDR1 (from WO2016028656) | GYSITSDYAWN | 887 |
| vhCDR2 (WO2016028656) | YISNSGSASYNPSLKS | 888 |
| vhCDR3 (WO2016028656) | LIYYDYGGAMNF | 889 |

Figure 3EEEE

From WO2016028656 (Table 4, reproduced herein)

| What | sequence | SEQ ID NO: |
|---|---|---|
| Light chain (SEQ ID NO:62 from WO2016028656) | DIVMTQSHKFMSTSVGDRVSITCKASQGVSTTVAWYQQKPGQSPKLLIYSASYRYTGVPDRFTGSGSGTDFTFTISSVQSEDLAVYYCQHYYSTPWTFGGGTKLEIK | 890 |
| vlCDR1 (from WO2016028656) | KASQGVSTTVA | 891 |
| vlCDR2 (WO2016028656) | SASYRYT | 892 |
| vlCDR3 (WO2016028656) | QHYYSTPWT | 893 |
| vlCDR2 variant (WO2016028656) | YASNLQT | 894 |
| vlCDR2 variant (WO2016028656) | YASSLQT | 895 |
| vlCDR2 variant (WO2016028656) | YASTLQT | 896 |
| vlCDR2 variant (WO2016028656) | YATTLQT | 897 |
| vlCDR2 variant (WO2016028656) | YASYLQT | 898 |
| vlCDR2 variant (WO2016028656) | YANQLQT | 899 |
| vlCDR2 variant (WO2016028656) | YAGSLQT | 900 |
| vlCDR2 variant (WO2016028656) | YASQLQT | 901 |
| vlCDR2 variant (WO2016028656) | YADSLQT | 902 |

Figure 3FFFF

From WO2016028656 (Table 4, reproduced herein)

| What | sequence | SEQ ID NO: |
|---|---|---|
| Light chain (SEQ ID NO:62 from WO2016028656) | DIVMTQSHKFMSTSVGDRVSITCKASQGVSTTVAWYQQKPGQSPKLLIYSASYRYTGVPDRFTG SGSGTDFTFTISSVQSEDLAVYYCQHYYSTPWTFGGGTKLEIK | 903 |
| vlCDR1 (from WO2016028656) | KASQGVSTTVA | 904 |
| vlCDR2 (WO2016028656) | SASYRYT | 905 |
| vlCDR3 (WO2016028656) | QHYYSTPWT | 906 |
| vlCDR3 variant (WO2016028656) | QQYYSGFT | 907 |
| vlCDR3 variant (WO2016028656) | QQYYSGYT | 908 |
| vlCDR3 variant (WO2016028656) | QQYYSGIT | 909 |
| vlCDR3 variant (WO2016028656) | QQYYSGVT | 910 |
| vlCDR3 variant (WO2016028656) | QQYYSGLT | 911 |

Figure 3GGGG

From WO2016028656 (Table 4, reproduced herein)

| What | sequence | SEQ ID NO: |
|---|---|---|
| Heavy chain (SEQ ID NO:63 from WO2016028656) | DVQLQESGPGLVKPSQSLSLTCTVTGYSITSDYAWNWIRQFPGNKLEWMGYISNSGSASYNPSLKSRISITRDTSKNQFFLQLNSVTTEDTATYYCATLIYYDYGGAMNFWGQGTSVTVSS | 912 |
| vhCDR1 (from WO2016028656) | GYSITSDYAWN | 913 |
| vhCDR2 (WO2016028656) | YISNSGSASYNPSLKS | 914 |
| vhCDR3 (WO2016028656) | LIYYDYGGAMNF | 915 |
| vHCDR3 variant (WO2016028656) | MPSFITLASLSTFEGYFDF | 916 |
| vHCDR3 variant (WO2016028656) | MPSFITLASLSTYEGYFDF | 917 |
| vHCDR3 variant (WO2016028656) | MPSFITLASLSTIEGYFDF | 918 |
| vHCDR3 variant (WO2016028656) | MPSFITLASLSTVEGYFDF | 919 |
| vHCDR3 variant (WO2016028656) | MPSFITLASLSTLEGYFDF | 920 |

Figure 3HHHH

From WO2016028656 (Table 4, reproduced herein)

| What | sequence | SEQ ID NO: |
|---|---|---|
| Heavy chain (SEQ ID NO:94 from WO2016028656) | EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSS | 921 |
| vhCDR1 (from WO2016028656) | SYVMH | 922 |
| vhCDR2 (WO2016028656) | YIDPYNDGAKYNEKFK | 923 |
| vhCDR3 (WO2016028656) | GPYGWYFDV | 924 |
| vHCDR2 variant (WO2016028656) | YIDPYNrGAKYNEKFG | 925 |
| vHCDR2 variant (WO2016028656) | YIDPYNlGAKYNEKFG | 926 |
| vHCDR2 variant (WO2016028656) | YIDPYNkGAKYNEKFG | 927 |
| vHCDR2 variant (WO2016028656) | YIDPYNfGAKYNEKFG | 928 |
| vHCDR2 variant (WO2016028656) | YIDPYNsGAKYNEKFG | 929 |
| vHCDR2 variant (WO2016028656) | YIDPYNyGAKYNEKFG | 930 |
| vHCDR2 variant (WO2016028656) | YIDPYNvGAKYNEKFG | 931 |
| vHCDR2 variant (WO2016028656) | YIDPYNDrAKYNEKFKG | 932 |
| vHCDR2 variant (WO2016028656) | YIDPYNDnAKYNEKFKG | 933 |
| vHCDR2 variant (WO2016028656) | YIDPYNDqAKYNEKFKG | 934 |
| vHCDR2 variant (WO2016028656) | YIDPYNDeAKYNEKFKG | 935 |
| vHCDR2 variant (WO2016028656) | YIDPYNDIAKYNEKFKG | 936 |
| vHCDR2 variant (WO2016028656) | YIDPYNDkAKYNEKFKG | 937 |
| vHCDR2 variant (WO2016028656) | YIDPYNDsAKYNEKFKG | 938 |
| vHCDR2 variant (WO2016028656) | YIDPYNDyAKYNEKFKG | 939 |
| vHCDR2 variant (WO2016028656) | YIDPYNDvAKYNEKFKG | 940 |

Figure 3IIII

From WO2016028656 (Table 4, reproduced herein)

| What | sequence | SEQ ID NO: |
|---|---|---|
| Light chain (SEQ ID NO:94 from WO2016028656) | DIQMTQSPASLSASVGETVTITCRASEHIYSYLSWYQQKQGKSPQLLVYNAKTLAEGVPSRFSGSG SGTQFSLKINSLQPEDFGTYYCQHHFGSPLTFGAGTTLELK | 941 |
| vlCDR1 (from WO2016028656) | RASEHIYSYLS | 942 |
| vlCDR2 (WO2016028656) | NAKTLAE | 943 |
| vlCDR3 (WO2016028656) | QHHFGSPLT | 944 |
| vLCDR2 variant (WO2016028656) | AAKTLAE | 945 |
| vLCDR2 variant (WO2016028656) | YAKTLAE | 946 |
| vLCDR2 variant (WO2016028656) | WAKTLAE | 947 |
| vLCDR2 variant (WO2016028656) | SAKTLAE | 948 |
| vLCDR2 variant (WO2016028656) | TAKTLAE | 949 |
| vLCDR2 variant (WO2016028656) | IAKTLAE | 950 |
| vLCDR2 variant (WO2016028656) | VAKTLAE | 951 |
| vLCDR2 variant (WO2016028656) | NNKTLAE | 952 |
| vLCDR2 variant (WO2016028656) | NIKTLAE | 953 |
| vLCDR2 variant (WO2016028656) | NLLTLAE | 954 |
| vLCDR2 variant (WO2016028656) | NTKTLAE | 955 |
| vLCDR2 variant (WO2016028656) | NVKTLAE | 956 |

Figure 3JJJJ

From WO2016028656 (Table 4, reproduced herein)

| What | sequence | SEQ ID NO: |
|---|---|---|
| Heavy chain (SEQ ID NO:124 from WO2016028656) | EVQLVQSGAEVKKPGASVKVSCKASGYTFSSYVMHWVRQAPGQRLEWIGYIDPYNDGAKYSQKFQGRVTLTRDTSASTAYMELSSLRSEDTAVYYCARGGPYGWYFDVWGQGTTVTVSS | 957 |
| vhCDR1 (from WO2016028656) | SYVMHW | 958 |
| vhCDR2 (from WO2016028656) | YIDPYNDGAKYSQKFQ | 959 |
| vhCDR3 (from WO2016028656) | GGPYGWYFDV | 960 |

From WO2016028656 (Table 4, reproduced herein)

| What | sequence | SEQ ID NO: |
|---|---|---|
| Heavy chain (SEQ ID NO:125 from WO2016028656) | EVQLVQSGAEVKKPGASVKVSCKASGYTFSSYVMHWVRQAPGQRLEWIGYIDPYNDGAKYSQKFQGRVTLTSDKSASTAYMELSSLRSEDTAVYYCARGGPYGWYFDVWGQGTTVTVSS | 961 |
| vhCDR1 (from WO2016028656) | SYVMH | 962 |
| vhCDR2 (from WO2016028656) | YIDPYNDGAKYSQKFQ | 963 |
| vhCDR3 (from WO2016028656) | GGPYGWYFDV | 964 |

Figure 3KKKK

From WO2016028656 (Table 4, reproduced herein)

| What | sequence | SEQ ID NO: |
|---|---|---|
| Heavy chain (SEQ ID NO:126 from WO2016028656) | EVQLVQSGAEVKKPGASVKVSCKASGYTFSSYVMHWVRQAPGQGLEWIGYIDPYNDGAKY AQKFQGRVTLTRDTSTSTVYMELSSLRSEDTAVYYCARGGPYGWYFDVWGQGTTVTVSS | 965 |
| vhCDR1 (from WO2016028656) | SYVMH | 966 |
| vhCDR2 (from WO2016028656) | YIDPYNDGAKYAQ | 967 |
| vhCDR3 (SEQ ID NO:13 from WO2016028656) | GGPYGWYFDV | 968 |

From WO2016028656 (Table 4, reproduced herein)

| What | sequence | SEQ ID NO: |
|---|---|---|
| Heavy chain (SEQ ID NO:127 from WO2016028656) | EVQLVQSGAEVKKPGASVKVSCKASGYTFSSYVMHWVRQAPGQGLEWIGYIDPYNDGAKY AQKFQGRVTLTSDKSTSTVYMELSLRSEDTAVYYCARGGPYGWYFDVWGQGTTVTVSS | 969 |
| vhCDR1 (from WO2016028656) | SYVMH | 970 |
| vhCDR2 (from WO2016028656) | YIDPYNDGAKYAQKFQ | 971 |
| vhCDR3 (from WO2016028656) | GGPYGWYFDV | 972 |

Figure 3LLLL

From WO2016028656 (Table 4, reproduced herein)

| What | sequence | SEQ ID NO: |
|---|---|---|
| Heavy chain (SEQ ID NO:128 from WO2016028656) | EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS | 973 |
| vhCDR1 (from WO2016028656) | SYVMH | 974 |
| vhCDR2 (from WO2016028656) | YIDPYNDGAKYAQKFQ | 975 |
| vhCDR3 (from WO2016028656) | GGPYGWYFDV | 976 |

From WO2016028656 (Table 4, reproduced herein)

| What | sequence | SEQ ID NO: |
|---|---|---|
| Heavy chain (SEQ ID NO:129 from WO2016028656) | EVQLVQSGAEVKKPGASVKVSCKASGYTFSSYVMHWVRQAPGQGLEWIGYIDPYNDGAKYAQKFQGRVTLTSDKSISTAYMELSRLRSDDTVVYYCARGGPYGWYFDVWGQGTTVTVSS | 977 |
| vhCDR1 (from WO2016028656) | SYVMH | 978 |
| vhCDR2 (from WO2016028656) | YIDPYNDGAKYAQKFQ | 979 |
| vhCDR3 (from WO2016028656) | GGPYGWYFDV | 980 |

Figure 3MMMM

From WO2016028656 (Table 4, reproduced herein)

| What | sequence | SEQ ID NO: |
|---|---|---|
| Light chain (SEQ ID NO:130 from WO2016028656) | DIQMTQSPSSLSASVGDRVTITCRASEHIYSYLSWYQQKPGKAPKLLIYNAKTLAEGVPSRFSG SGSGTDFTLTISSLQPEDFATYYCQHHFGSPLTFGQGTRLEIK | 981 |
| vlCDR1 (from WO2016028656) | RASEHIYSYLS | 982 |
| vlCDR2 (from WO2016028656) | NAKTLAE | 983 |
| vlCDR3 (from WO2016028656) | QHHFGSPLT | 984 |

From WO2016028656 (Table 4, reproduced herein)

| What | sequence | SEQ ID NO: |
|---|---|---|
| Light chain (SEQ ID NO:131 from WO2016028656) | DIQMTQSPSSLSASVGDRVTITCRASEHIYSYLSWYQQKPGKAPKLLIYNAKTLAE GVPSRFSGSGSGTQFTLTISSLQPEDFATYYCQHHFGSPLTFGQGTRLEIK | 985 |
| vlCDR1 (from WO2016028656) | RASEHIYSYLS | 986 |
| vlCDR2 (from WO2016028656) | NAKTLAE | 987 |
| vlCDR3 (from WO2016028656) | QHHFGSPLT | 988 |

Figure 3NNNN

From WO2016028656 (Table 4, reproduced herein)

| What | sequence | SEQ ID NO: |
|---|---|---|
| Light chain (SEQ ID NO:132 from WO2016028656) | DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK | 989 |
| vlCDR1 (from WO2016028656) | RASEHIYSYLS | 990 |
| vlCDR2 (from WO2016028656) | NAKTLAE | 991 |
| vlCDR3 (from WO2016028656) | QHHFGSPLT | 992 |

From WO2016028656 (Table 4, reproduced herein)

| What | sequence | SEQ ID NO: |
|---|---|---|
| Light chain (SEQ ID NO:133 from WO2016028656) | DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK | 993 |
| vlCDR1 (from WO2016028656) | RASEHIYSYLS | 994 |
| vlCDR2 (from WO2016028656) | NAKTLAE | 995 |
| vlCDR3 (from WO2016028656) | QHHFGSPLT | 996 |

Figure 3OOOO

From WO2016028656 (Table 4, reproduced herein)

| What | sequence | SEQ ID NO: |
|---|---|---|
| Heavy chain (SEQ ID NO:129 from WO2016028656) | EVQLVQSGAEVKKPGASVKVSCKASGYTFSSYVMHWVRQAPGQGLEWIGYIDPYNDGAKYA QKFQGRVTLTSDKSISTAYMELSRLRSDDTVVYYCARGGPYGWYFDVWGQGTTVTVSS | 997 |
| vhCDR2 variant (from WO2016028656) | YIDPYNDGAKYAQKFQG | 998 |
| vhCDR2 variant (from WO2016028656) | YIDPYNDGAKYSQKFQG | 999 |

From WO2016028656 (Table 4, reproduced herein)

| What | sequence | SEQ ID NO: |
|---|---|---|
| Heavy chain (SEQ ID NO:129 from WO2016028656) | EVQLVQSGAEVKKPGASVKVSCKASGYTFSSYVMHWVRQAPGQGLEWIGYIDPYNDGAKYAQ KFQGRVTLTSDKSISTAYMELSRLRSDDTVVYYCARGGPYGWYFDVWGQGTTVTVSS | 1000 |
| vhCDR3 variant (from WO2016028656) | GGPYGAYFDV | 1001 |
| vhCDR3 variant (from WO2016028656) | GGPYGDYFDV | 1002 |
| vhCDR3 variant (from WO2016028656) | GGPYGEYFDV | 1003 |
| vhCDR3 variant (from WO2016028656) | GGPYGFYFDV | 1004 |
| vhCDR3 variant (from WO2016028656) | GGPYGGYFDV | 1005 |
| vhCDR3 variant (from WO2016028656) | GGPYGIYFDV | 1006 |
| vhCDR3 variant (from WO2016028656) | GGPYGKYFDV | 1007 |
| vhCDR3 variant (from WO2016028656) | GGPYGNYFDV | 1008 |
| vhCDR3 variant (from WO2016028656) | GGPYGQYFDV | 1009 |
| vhCDR3 variant (from WO2016028656) | GGPYGRYFDV | 1010 |
| vhCDR3 variant (from WO2016028656) | GGPYGSYFDV | 1011 |
| vhCDR3 variant (from WO2016028656) | GGPYGTYFDV | 1012 |
| vhCDR3 variant (from WO2016028656) | GGPYGVYFDV | 1013 |
| vhCDR3 variant (from WO2016028656) | GGPYGYYFDV | 1014 |

Figure 3PPPP

From WO2016028656 (Table 4, reproduced herein)

| What | sequence | SEQ ID NO: |
|---|---|---|
| VH 18G10 (SEQ ID NO:136 from WO2016028656) | QVQLMESGPGLVQPSQTLSLTCTVSGFPLTSYTVHWVRQPPGKGLEWIGAIWSSGSTDYNSALKSRLNINRDSSKSQVFLKMNSLQTEDTAIYFCTKSGWAFFDYWGQGVMVTVSS | 1015 |
| VL 18G10 (SEQ ID NO:137 from WO2016028656) | DIQMTQSPSLLSASVGDRVTLNCIASQNIYKSLAWYQLKLGEAPKLLIYNANSLQAGIPSRFSGSGSGTDFALTISGLQPEDVATYFCQQYSGGYTFGAGTKLELK | 1016 |

From WO2016028656 (Table 4, reproduced herein)

| What | sequence | SEQ ID NO: |
|---|---|---|
| VH 11A11 (SEQ ID NO:138 from WO2016028656) | EVQLVESGGDLVQPGRSLKISCVASGFTFSDYYMAWVRLAPQKGLEWVASISYEGSRTHYGDSVRGRFIISRDNPKNILYLQMNSLGSEDTATYFCARHTGTLDWLVYWGQGTLVIVSS | 1017 |
| VL 11A11 (SEQ ID NO:139 from WO2016028656) | NIVMAQSPKSMSISAGDRVTMNCKASQNVDNNIAWYQQKPGQSPKLLIFYASNRYSGVPDRFTGGGYGTDFTLTIKSVQAEDAAFYYCQRIYNFPTFGSGTKLEIK | 1018 |

Figure 5A
CHA.7.518.1

| What | sequence | SEQ ID NO: |
|---|---|---|
| Variable heavy (vh) domain | QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSS | 1019 |
| vhCDR1 | GYTFTDYN | 1020 |
| vhCDR2 | IYPYIGGS | 1021 |
| vhCDR3 | AREDKTARNAMDY | 1022 |
| Full length HC (IgG4(S241P)) | QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCP*CPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK | 1023 |
| Full length HC for CHA.7.518.1.H4(S241P) | | |
| Variable light (vl) domain | DIQMTQSPSSLSASVGDRVTITCRVSENIYSNLAWYQQKPGKAPKLLIYEATNLAEGVPSRFSGSGSGTDFTLTISSLQPEDFATYCQHFWGTPYTFGQGTKLEIK | 1024 |
| vlCDR1 | ENIYSN | 1025 |
| vlCDR2 | EAT | 1026 |
| vlCDR3 | QHFWGTPYT | 1027 |
| Full length light chain for CHA.7.518.1.H4(S241P) | DIQMTQSPSSLSASVGDRVTITCRVSENIYSNLAWYQQKPGKAPKLLIYEATNLAEGVPSRFSGSGSGTDFTLTISSLQPEDFATYCQHFWGTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1028 |

Figure 5B
CHA.7.538.1.2

| What | sequence | SEQ ID NO: |
|---|---|---|
| Variable heavy (vh) domain | QVQLVQSGAEVKKPGASVKVSCKASGYAFTNYLIEWVRQAPGQGLEWIGVINPGSGGIYAQKFQGRVTMTADTSTSTVY MELSSLRSEDTAVYYCARSETHDTWFAYWGQGTLVTVSS | 1029 |
| vhCDR1 | GYAFTNYL | 1030 |
| vhCDR2 | INPGSGGI | 1031 |
| vhCDR3 | ARSETHDTWFAY | 1032 |
| Full length HC (IgG4(S241P) | QVQLVQSGAEVKKPGASVKVSCKASGYAFTNYLIEWVRQAPGQGLEWIGVINPGSGGIYAQKFQGRVTMTADTSTSTVY MELSSLRSEDTAVYYCARSETHDTWFAYWGQGTLVTVSSASTKGPSVFPLAPCSRSTSESTAALGCLVKDYFPEPVTVSWNS GALTSGVHTFPAVLQSSGLYSLSSVVTVPSSSLGTKTYTCNVDHKPSNTKVDKRVESKYGPPCPPCPAPEFLGGPSVFLFPPK PKDTLMISRTPEVTCVVVDVSQEDPEVQFNWYVDGVEVHNAKTKPREEQFNSTYRVVSVLTVLHQDWLNGKEYKCKVSN KGLPSSIEKTISKAKGQPREPQVYTLPPSQEEMTKNQVSLTCLVKGFYPSDIAVEWESNGQPENNYKTTPPVLDSDGSFFLYS RLTVDKSRWQEGNVFSCSVMHEALHNHYTQKSLSLSPGK | 1033 |
| Full length HC for CHA.7.538.1.2. H4(S241P) | | |
| Variable light (vl) domain | DIQMTQSPSSLSASVGDRVTITCKASQSVRIAVAWFQQKPGKAPKALIYLASTRHTGVPSRFSGSGSGTDFTLTISSVQPEDFA TYYCLQHWNYPYTFGQGTKLEIK | 1034 |
| vlCDR1 | QSVRIA | 1035 |
| vlCDR2 | LAS | 1036 |
| vlCDR3 | LQHWNYPYT | 1037 |
| Full length light chain for CHA.7.518.1.H 4(S241P) | DIQMTQSPSSLSASVGDRVTITCKASQSVRIAVAWFQQKPGKAPKALIYLASTRHTGVPSRFSGSGSGTDFTLTISSVQPEDFA TYYCLQHWNYPYTFGQGTKLEIKRTVAAPSVFIFPPSDEQLKSGTASVVCLLNNFYPREAKVQWKVDNALQSGNSQESVTE QDSKDSTYSLSSTLTLSKADYEKHKVYACEVTHQGLSSPVTKSFNRGEC | 1038 |

Figure 5C

From Zhu (WO 2017/041004)

| What | sequence | SEQ ID NO: |
|---|---|---|
| Heavy chain (SEQ ID NO:5 from WO 2017/041004) | EVQLQQSGAELVRSGASVKMSCKVNDYTFTNYNMHWLRQTPGQGLEWIGYIYPGNGDTNY NQKFKGKATLTADTSSSTAYMQIISLTSEDPAVYFCARQGIHYYYIDVWGAGTTVTVSSG | 1039 |
| vhCDR1 (SEQ ID NO:6 from WO 2017/041004) | DYTFTNYNMH | 1040 |
| vhCDR2 (SEQ ID NO:7 from WO 2017/041004) | YIYPGNGDTNYNQ | 1041 |
| vhCDR3 (SEQ ID NO:8 from WO 2017/041004) | QGIHYYYIDV | 1042 |
| Light chain (SEQ ID NO:3 from WO 2017/041004) | DIEMTQSPATLSVTPGDRVSLSCRASQSIRDYLHWYQQKSHESPRLLIKYVSQSISGIPS RFSGSGSGSEFTLSINSVEPEDVGVYYCQNGHSLPLTFGSGTKLEIKRTV | 1043 |
| vlCDR1 (SEQ ID NO:9 from WO 2017/041004) | RASQSIRDYLH | 1044 |
| vlCDR2 (SEQ ID NO:10 from WO 2017/041004) | YVSQSIS | 1045 |
| vlCDR3 (SEQ ID NO:11 from WO 2017/041004) | QNGHSLPLT | 1046 |

Figure 5D

From Zhu (WO 2017/041004)

| What | sequence | SEQ ID NO: |
|---|---|---|
| Heavy chain (SEQ ID NO:32 from WO 2017/041004) | QVQLQQSGAELAKPGASVKMSCKASGYTFTSDWMHWVKQRPGQGLEWIGYINPSTGYTEYNQKFKDKATLTADKSSSTAYMQLRSLTSEDSAVYYCARGSSGSWFAYWGQGTLVTVSA | 1047 |
| vhCDR1 (SEQ ID NO:34 from WO 2017/041004) | SDWMH | 1048 |
| vhCDR2 (SEQ ID NO:35 from WO 2017/041004) | YINPSTGYTEYNQKFKD | 1049 |
| vhCDR3 (SEQ ID NO:36 from WO 2017/041004) | GSSGSWFAY | 1050 |
| Light chain (SEQ ID NO:33 from WO 2017/041004) | DIVLTQSPASLAVSLGQRATISCRASQSVSTSSSYSYMHWYQQKPGQPPKLLIKYASNLESGVPARFSGSGSGTDFTLNIHPVEEEDTATYYCQHSWEIPYTFGGGTKLEIK | 1051 |
| vlCDR1 (SEQ ID NO:37 from WO 2017/041004) | RASQSVSTSSSYSYMH | 1052 |
| vlCDR2 (SEQ ID NO:38 from WO 2017/041004) | YASNLES | 1053 |
| vlCDR3 (SEQ ID NO:39 from WO 2017/041004) | QHSWEIPYT | 1054 |

Figure 5E

From Zhu (WO 2017/041004)

| What | sequence | SEQ ID NO: |
|---|---|---|
| Heavy chain (SEQ ID NO:32 from WO 2017/041004) | QVQLQQSGAELAKPGASVKMSCKASGYTFTSDWMHWVKQRPGQGLEWIGYINPSTGYTEY NQKFKDKATLTADKSSSTAYMQLRSLTSEDSAVYYCARGSSGSWFAYWGQGTLVTVSA | 1055 |
| vhCDR1 (SEQ ID NO:34 from WO 2017/041004) | SDWMH | 1056 |
| vhCDR2 (SEQ ID NO:35 from WO 2017/041004) | YINPSTGYTEYNQKFKD | 1057 |
| vhCDR3 (SEQ ID NO:36 from WO 2017/041004) | GSSGSWFAY | 1058 |
| Light chain (SEQ ID NO:40 from WO 2017/041004) | DVVMTQTPLTLSVTIGQPASISCKSSQSLLNSDGKTYLNWLLQRPGQSPKRLIYLVSKLD SGVPDRFTGSGSGTDFTLKISRVEAEDLGVYYCWQGTHFPRTFGGGTKLEIK | 1059 |
| vlCDR1 (SEQ ID NO:41 from WO 2017/041004) | KSSQSLLNSDGKTYLN | 1060 |
| vlCDR2 (SEQ ID NO:42 from WO 2017/041004) | LVSKLDS | 1061 |
| vlCDR3 (SEQ ID NO:43 from WO 2017/041004) | WQGTHFPRT | 1062 |

Figure 5F

From WO 2018/017864 (334M5 antibody)

| What | sequence | SEQ ID NO: |
|---|---|---|
| Heavy chain (SEQ ID NO:30 from WO 2018/017864) | EVQLQQSVAELVRPGTSVTISCKASGYTFTNYWLGWVKQRPGHGLEWIGDIFPGGDYPNY NEKFKGKATLTADTSSSTAYMQLSSLTSEDSSVYFCTRGYFDVWGAGTTVTVSS | 1063 |
| vhCDR1 (SEQ ID NO:31 from WO 2018/017864) | TNYWLG | 1064 |
| vhCDR2 (SEQ ID NO:32 from WO 2018/017864) | DIFPGGDYPNYNEKFKG | 1065 |
| vhCDR3 (SEQ ID NO:33 from WO 2018/017864) | TRGYFDV | 1066 |
| Light chain (SEQ ID NO:25 from WO 2018/017864) | DIQMTQSPSSLSVSAGEKVTMSCKSSQSLLNSENQKNYLAWFQQKPGQPPKMLIYGASTR ESGVPDRFTGSGSGTDFTLTISSVQAEDLAVYYCQNDHSYPFTFGSGTKLEIKR | 1067 |
| vlCDR1 (SEQ ID NO:26 from WO 2018/017864) | KSSQSLLNSENQKNYLA | 1068 |
| vlCDR2 (SEQ ID NO:27 from WO 2018/017864) | GASTRES | 1069 |
| vlCDR3 (SEQ ID NO:28 from WO 2018/017864) | QNDHSYP | 1070 |

Figure 7A

Pembrolizumab (Anti-PD1 hIgG4)

| What | sequence | SEQ ID NO: |
|---|---|---|
| Variable heavy (vh) domain | EVQLVLSGGGFVQPGGSLKLSCAASGFTFSSYAMSWVRQNPERRLVWVATITGGGRNTYYPDSVKGRFTISR DNAKNTLYLQMSSLRSEDTAMYYCTRQGYDGYTWFAYWGQGTLVTVSS | 1071 |
| vhCDR1 | GFTFSSYA | 1072 |
| vhCDR2 | ITGGGRNT | 1073 |
| vhCDR3 | TRQGYDGYTWFAY | 1074 |
| Full length HC | EVQLVLSGGGFVQPGGSLKLSCAASGFTFSSYAMSWVRQNPERRLVWVATITGGGRNTYYPDSVKGRFTISR DNAKNTLYLQMSSLRSEDTAMYYCTRQGYDGYTWFAYWGQGTLVTVSSASTKGPSVFPLAPCSRSTSESTA ALGCLVKDYFPEPVTVSWNSGALTSGVHTFPAVLQSSGLYSLSSVVTVPSSSLGTKTYTCNVDHKPSNTKVD KRVESKYGPPCPPCPAPEFLGGPSVFLFPPKPKDTLMISRTPEVTCVVVDVSQEDPEVQFNWYVDGVEVHNA KTKPREEQFNSTYRVVSVLTVLHQDWLNGKEYKCKVSNKGLPSSIEKTISKAKGQPREPQVYTLPPSQEEMT KNQVSLTCLVKGFYPSDIAVEWESNGQPENNYKTTPPVLDSDGSFFLYSRLTVDKSRWQEGNVFSCSVMHE ALHNHYTQKSLSLSPGK | 1075 |
| Variable light (vl) domain | DIVLTQSPTSLAVSLGQRATISCRASESVDNSGISFMNWFQQKPGQPPKLLIYAASNPGSGVPARFSGSGSGT DFSLNIHPMEEDDTAMYFCQQSKEVPWTFGGGTELEIKR | 1076 |
| vlCDR1 | ESVDNSGISF | 1077 |
| vlCDR2 | AAS | 1078 |
| vlCDR3 | QQSKEVPWT | 1079 |
| Full length light chain | DIVLTQSPTSLAVSLGQRATISCRASESVDNSGISFMNWFQQKPGQPPKLLIYAASNPGSGVPARFSGSGSGT DFSLNIHPMEEDDTAMYFCQQSKEVPWTFGGGTELEIKRTVAAPSVFIFPPSDEQLKSGTASVVCLLNNFYPR EAKVQWKVDNALQSGNSQESVTEQDSKDSTYSLSSTLTLSKADYEKHKVYACEVTHQGLSSPVTKSFNRGE C | 1080 |

Figure 7B

Pembrolizumab (Anti-PD1 from WO2016028656)

| What | sequence | SEQ ID NO: |
|---|---|---|
| Full length HC (SEQ ID NO:33 from WO2016028656) | QVQLVQSGVEVKKPGASVKVSCKASGYTFTNYYMYWVRQAPGQGLEWMGGINPSNGGTNFNEKFKNRV TLTTDSSTTTAYMELKSLQFDDTAVYYCARRDYRFDMGFDYWGQGTTVTVSSASTKGPSVFPLAPCSRSTSES TAALGCLVKDYFPEPVTVSWNSGALTSGVHTFPAVLQSSGLYSLSSVVTVPSSSLGTKTYTCNVDHKPSNTK VDKRVESKYGPPCPPCPAPEFLGGPSVFLFPPKPKDTLMISRTPEVTCVVVDVSQEDPEVQFNWYVDGVEVH NAKTKPREEQFNSTYRVVSVLTVLHQDWLNGKEYKCKVSNKGLPSSIEKTISKAKGQPREPQVYTLPPSQEE MTKNQVSLTCLVKGFYPSDIAVEWESNGQPENNYKTTPPVLDSDGSFFLYSRLTVDKSRWQEGNVFSCSVM HEALHNHYTQKSLSLSLGK | 1081 |
| Full length light chain (SEQ ID NO:34 from WO2016028656) | EIVLTQSPATLSLSPGERATLSCRASKGVSTSGYSYLHWYQQKPGQAPRLLIYLASYLESGVPARFSGSGSGTD FTLTISSLEPEDFAVYYCQHSRDLPLTFGGGTKVEIKRTVAAPSVFIFPPSDEQLKSGTASVVCLLNNFYPREAK VQWKVDNALQSGNSQESVTEQDSKDSTYSLSSTLTLSKADYEKHKVYACEVTHQGLSSPVTKSFNRGEC | 1082 |

Figure 7C

Nivolumab (Anti-PD1 hIgG4)

| What | sequence | SEQ ID NO: |
|---|---|---|
| Variable heavy (vh) domain | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSS | 1083 |
| vhCDR1 | GITFSNSG | 1084 |
| vhCDR2 | IWYDGSKR | 1085 |
| vhCDR3 | ATNDDY | 1086 |
| Full length HC | QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK | 1087 |
| Variable light (vl) domain | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKR | 1088 |
| vlCDR1 | QSVSSY | 1089 |
| vlCDR2 | DAS | 1090 |
| vlCDR3 | QQSSNWPRT | 1091 |
| Full length light chain | EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1092 |

Figure 7D

Nivolumab (Anti-PD1 from WO2016028656)

| What | sequence | SEQ ID NO: |
|---|---|---|
| Full length heavy chain (SEQ ID NO:35 from WO2016028656) | QVQLVESGGGVVQPGRSLRLDCKASGITFSNSGMHWVRQAPGKGLEWVAVIWYDGSKRYYADSVKGRFTI SRDNSKNTLFLQMNSLRAEDTAVYYCATNDDYWGQGTLVTVSSASTKGPSVFPLAPCSRSTSESTAALGCL VKDYFPEPVTVSWNSGALTSGVHTFPAVLQSSGLYSLSSVVTVPSSSLGTKTYTCNVDHKPSNTKVDKRVES KYGPPCPPCPAPEFLGGPSVFLFPPKPKDTLMISRTPEVTCVVVDVSQEDPEVQFNWYVDGVEVHNAKTKP REEQFNSTYRVVSVLTVLHQDWLNGKEYKCKVSNKGLPSSIEKTISKAKGQPREPQVYTLPPSQEEMTKNQV SLTCLVKGFYPSDIAVEWESNGQPENNYKTTPPVLDSDGSFFLYSRLTVDKSRWQEGNVFSCSVMHEALHN HYTQKSLSLSLGK | 1093 |
| Full length light chain (SEQ ID NO:36 from WO2016028656) | EIVLTQSPATLSLSPGERATLSCRASQSVSSYLAWYQQKPGQAPRLLIYDASNRATGIPARFSGSGSGTDFTLTI SSLEPEDFAVYYCQQSSNWPRTFGQGTKVEIKRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC | 1094 |

Figure 7E

Cemiplimab (REGN2810; anti-PD1)

| What | sequence | SEQ ID NO: |
|---|---|---|
| Variable heavy (vh) domain (SEQ ID NO:1 from US20170174779) | EVQLLESGGVLVQPGGSLRLSCAASGFTFSNFGMTWVRQAPGKGLEWVSGISGGGRDTYF ADSVKGRFTISRDNSKNTLYLQMNSLKGEDTAVYYCVKWGNIYFDYWGQGTLVTVSS | 1095 |
| vhCDR1 (SEQ ID NO:3 from US20170174779) | GFTFSNFG | 1096 |
| vhCDR2 (SEQ ID NO:4 from US20170174779) | ISGGGRDT | 1097 |
| vhCDR3 (SEQ ID NO:5 from US20170174779) | VKWGNIYFDY | 1098 |
| Variable light (vl) domain (SEQ ID NO:2 from US20170174779) | DIQMTQSPSSLSASVGDSITITCRASLSINTFLNWYQQKPGKAPNLLIYAASSLHGGVPS RFSGSGSGTDFTLTIRTLQPEDFATYYCQQSSNTPFTFGPGTVVDFR | 1099 |
| vlCDR1 (SEQ ID NO:6 from US20170174779) | LSINTF | 1100 |
| vlCDR2 (SEQ ID NO:7 from US20170174779) | AAS | 1101 |
| vlCDR3 (SEQ ID NO:8 from US20170174779) | QQSSNTPFT | 1102 |

Figure 7F

Cemiplimab (REGN2810; anti-PD1)

| What | sequence | SEQ ID NO: |
|---|---|---|
| Full length heavy chain (SEQ ID NO:9 from US20170174779) | EVQLLESGGVLVQPGGSLRLSCAASGFTFSNFGMTWVRQAPGKGLEWVSGISGGGRDTYFADSVKGRFTISR DNSKNTLYLQMNSLKGEDTAVYYCVKWGNIYFDYWGQGTLVTVSSASTKGPSVFPLAPCSRSTSESTAALG CLVKDYFPEPVTVSWNSGALTSGVHTFPAVLQSSGLYSLSSVVTVPSSSLGTKTYTCNVDHKPSNTKVDKRV ESKYGPPCPPCPAPEFLGGPSVFLFPPKPKDTLMISRTPEVTCVVVDVSQEDPEVQFNWYVDGVEVHNAKTK PREEQFNSTYRVVSVLTVLHQDWLNGKEYKCKVSNKGLPSSIEKTISKAKGQPREPQVYTLPPSQEEMTKNQ VSLTCLVKGFYPSDIAVEWESNGQPENNYKTTPPVLDSDGSFFLYSRLTVDKSRWQEGNVFSCSVMHEALH NHYTQKSLSLSLGK | 1103 |
| Full length light chain (SEQ ID NO:10 from US20170174779) | DIQMTQSPSSLSASVGDSITITCRASLSINTFLNWYQQKPGKAPNLLIYAASSLHGGVPSRFSGSGSGTDFTLTI RTLQPEDFATYYCQQSSNTPFTFGPGTVVDFRRTVAAPSVFIFPPSDEQLKSGTASVVCLLNNFYPREAKVQ WKVDNALQSGNSQESVTEQDSKDSTYSLSSTLTLSKADYEKHKVYACEVTHQGLSSPVTKSFNRGEC | 1104 |

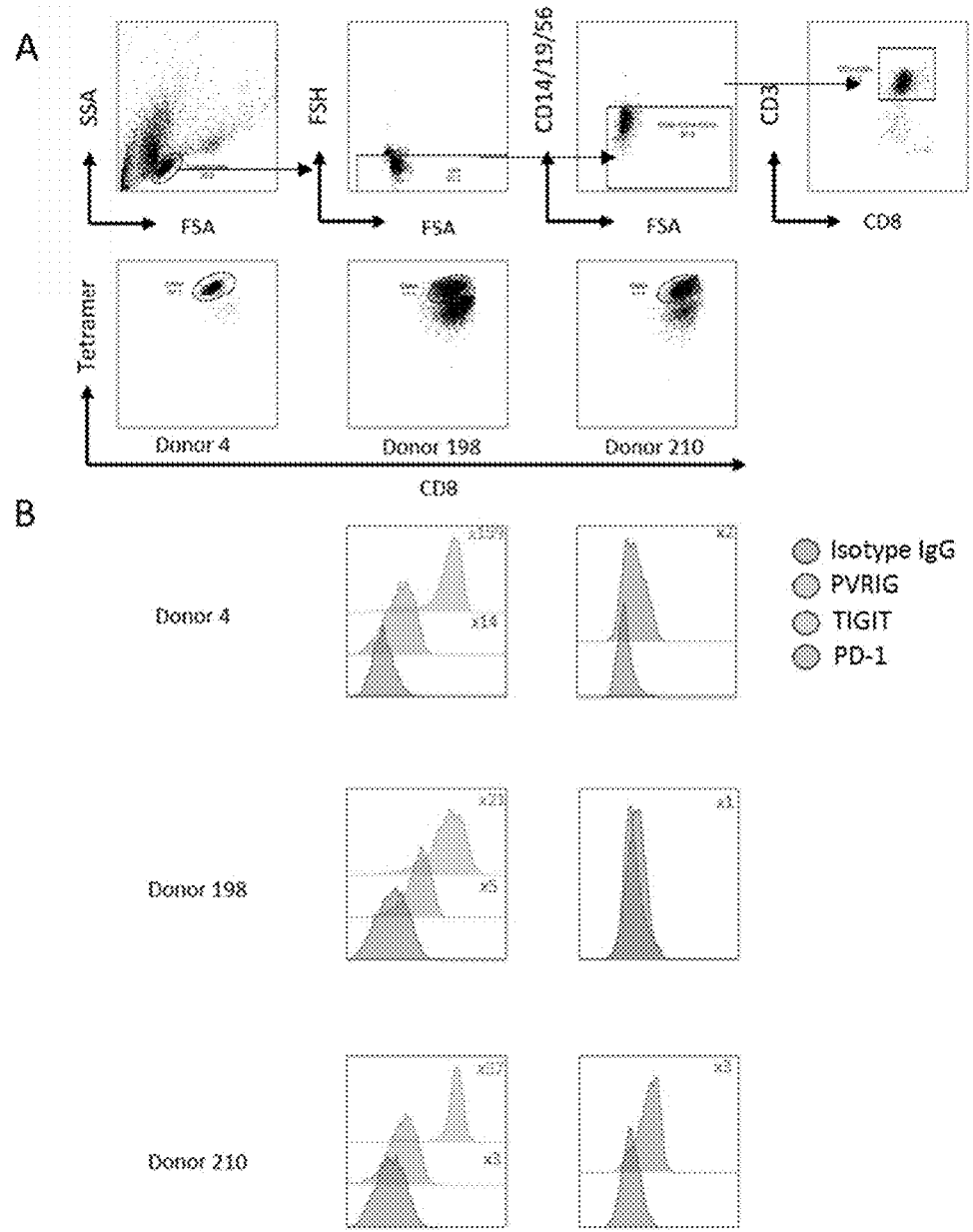

FIGURE 9
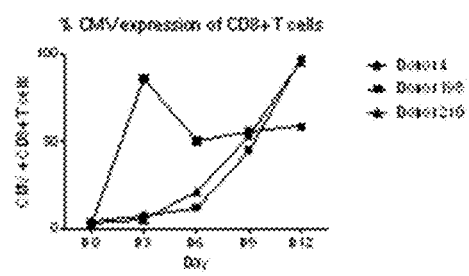
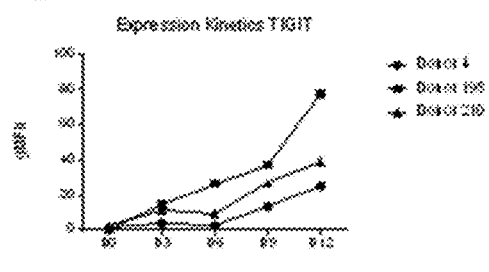
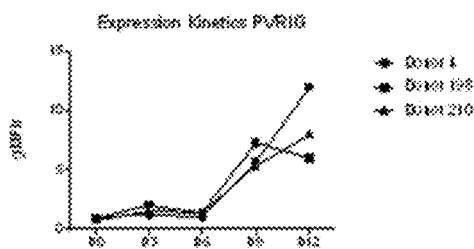
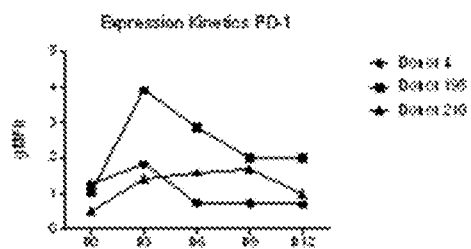

Figure 23
A. PVRL2 (HPA-012759)
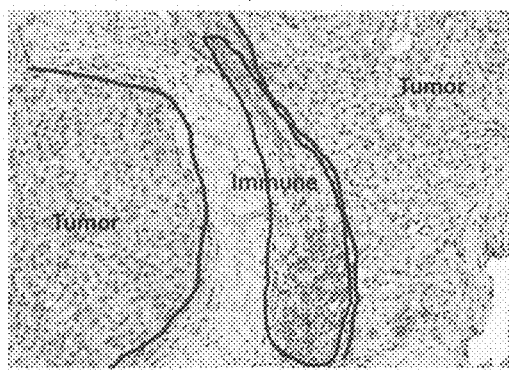
B. PD-L1 (SP142)
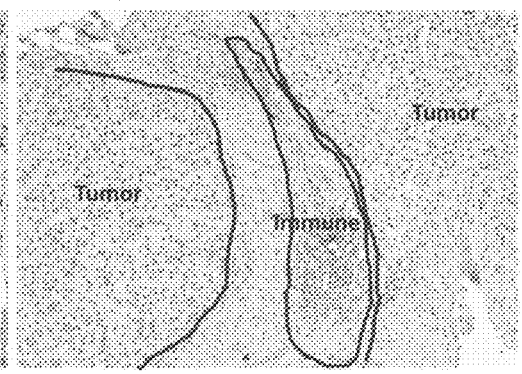

Figure 26
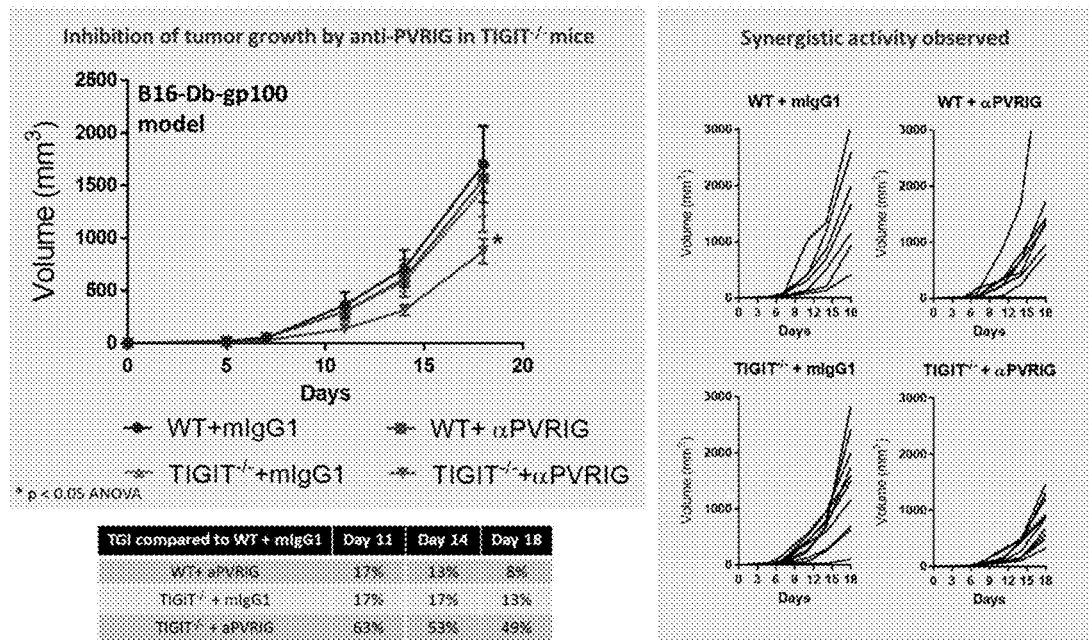
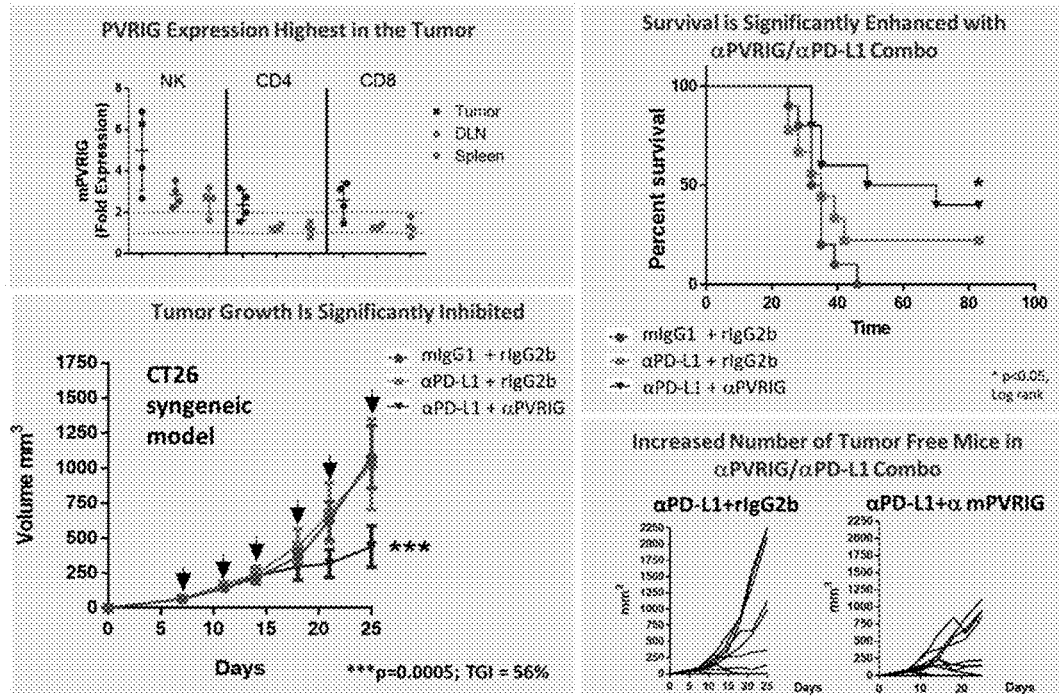

Fgiure 28A
Figure 28B
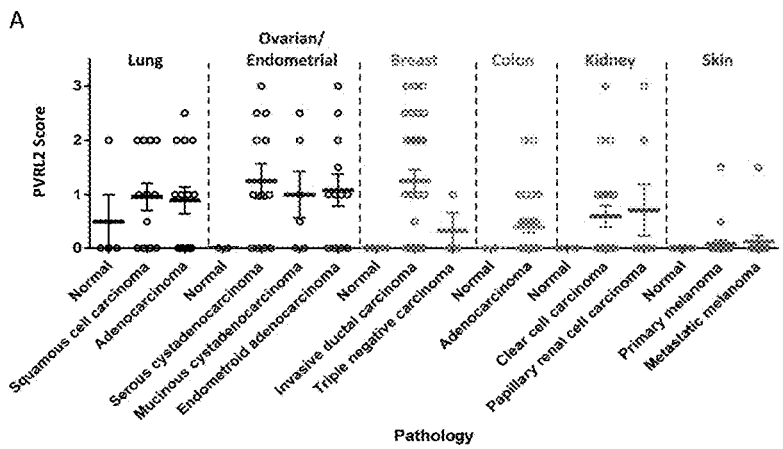
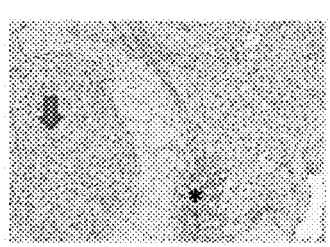
Figure 28C
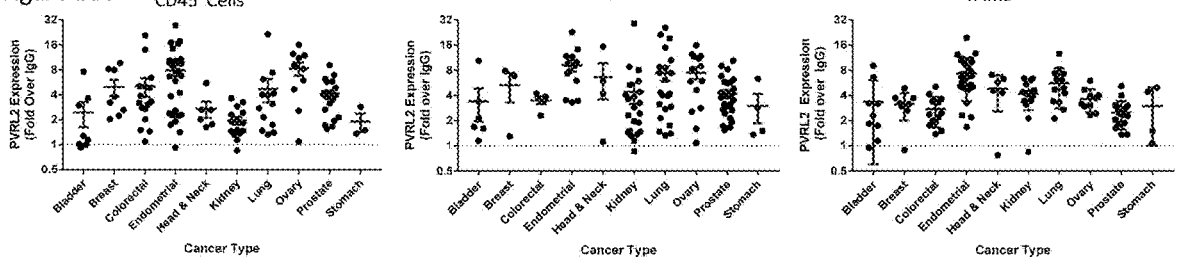
Figure 28D        Figure 28 E
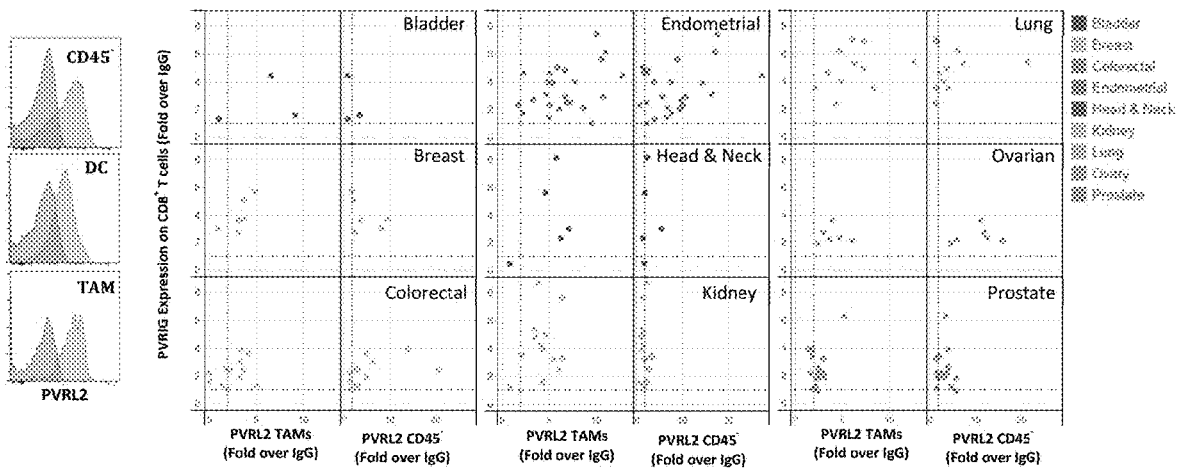

Figure 28F

|  | All Tumors | | | PD-L1+ | | | PD-L1- | | |
| --- | --- | --- | --- | --- | --- | --- | --- | --- | --- |
| Tissue Type | PVRL2+ | Total | % Positive | PVRL2+ | Total | % Positive | PVRL2+ | Total | % Positive |
| Lung | | | | | | | | | |
| Normal | 1 | 4 | 25 | N/A | N/A | N/A | N/A | N/A | N/A |
| Adenocarcinoma | 8 | 14 | 57 | 3 | 5 | 60 | 5 | 9 | 56 |
| Squamous cell carcinoma | 8 | 13 | 62 | 5 | 7 | 71 | 3 | 6 | 50 |
| Ovarian | | | | | | | | | |
| Normal | 0 | 2 | 0 | N/A | N/A | N/A | N/A | N/A | N/A |
| Serous cystadenocarcinoma | 8 | 12 | 67 | 2 | 3 | 67 | 6 | 9 | 67 |
| Mucinous cystadenocarcinoma | 4 | 6 | 67 | 1 | 1 | 100 | 3 | 5 | 60 |
| Endometrioid adenocarcinoma | 8 | 12 | 67 | 3 | 4 | 75 | 5 | 8 | 63 |
| Colon | | | | | | | | | |
| Normal | 0 | 2 | 0 | N/A | N/A | N/A | N/A | N/A | N/A |
| Adenocarcinoma | 16 | 30 | 53 | 8 | 14 | 57 | 7 | 16 | 44 |
| Skin | | | | | | | | | |
| Normal | 0 | 4 | 0 | N/A | N/A | N/A | N/A | N/A | N/A |
| Melanoma-Primary | 3 | 24 | 13 | 1 | 4 | 25 | 2 | 20 | 10 |
| Metastatic melanoma | 1 | 12 | 8 | 1 | 4 | 25 | 0 | 8 | 0 |
| Renal | | | | | | | | | |
| Normal | 0 | 3 | 0 | N/A | N/A | N/A | N/A | N/A | N/A |
| Clear cell carcinoma | 8 | 20 | 40 | 0 | 0 | N/A | 8 | 20 | 40 |
| Papillary renal cell carcinoma | 2 | 7 | 29 | 1 | 1 | 100 | 1 | 6 | 17 |
| Breast | | | | | | | | | |
| TNBC | 1 | 3 | 33 | 0 | 0 | N/A | 1 | 3 | 33 |
| Invasive ductal carcinoma | 19 | 30 | 63 | 6 | 10 | 60 | 13 | 20 | 65 |

Figure 40
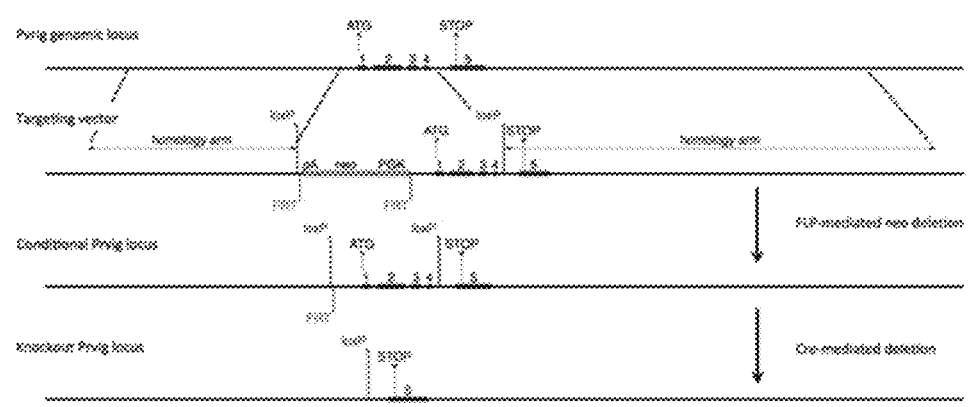
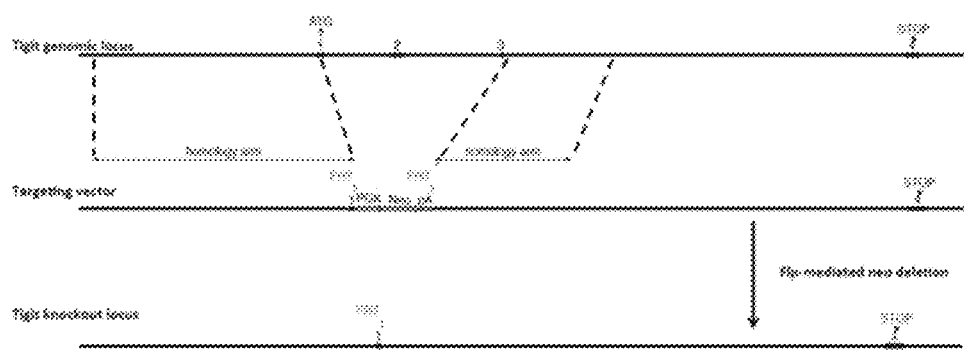

Figure 45

CPA9.086 CDR sequences

| Definition | H-CDR1 | H-CDR2 | H-CDR3 | L-CDR1 | L-CDR2 | L-CDR3 |
|---|---|---|---|---|---|---|
| IMGT | GFTFSSYA (SEQ ID NO:1105) | ISYAGEVK (SEQ ID NO:1107) | ARDPLPLHYYGMDV (SEQ ID NO:1109) | SSNMGRRP (SEQ ID NO:1111) | SQN (SEQ ID NO:1113) | AVWDDIGRVLQ (SEQ ID NO:1115) |
| Kabat | SYAMH (SEQ ID NO:1106) | VISYAGEVKYYADSVKG (SEQ ID NO:1108) | DPLPLHYYGMDV (SEQ ID NO:1110) | SGSSSNMGRRPVN (SEQ ID NO:1112) | SQNQRPS (SEQ ID NO:1114) | AVWDDIGRVLQ (SEQ ID NO:1116) |

Figure 46
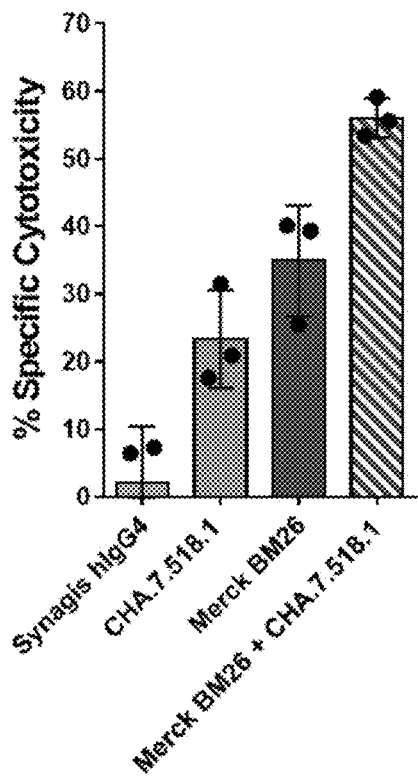
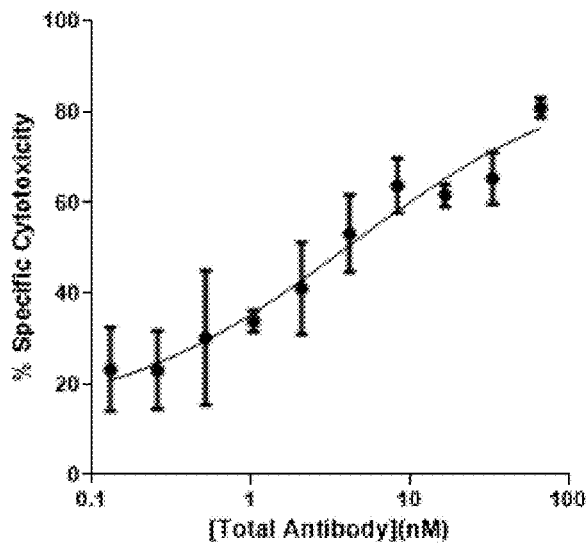
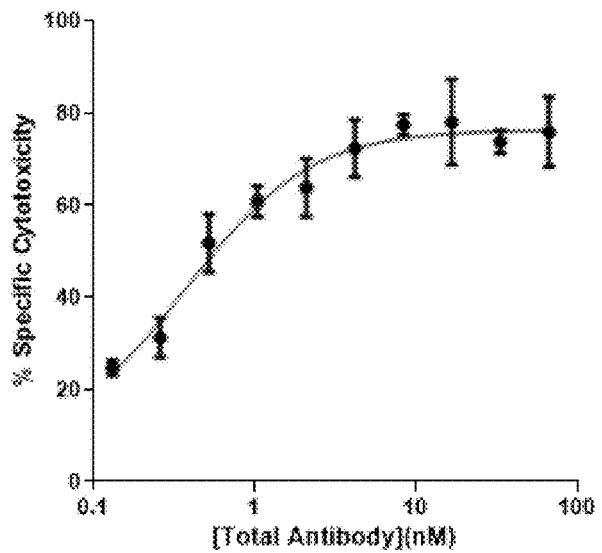

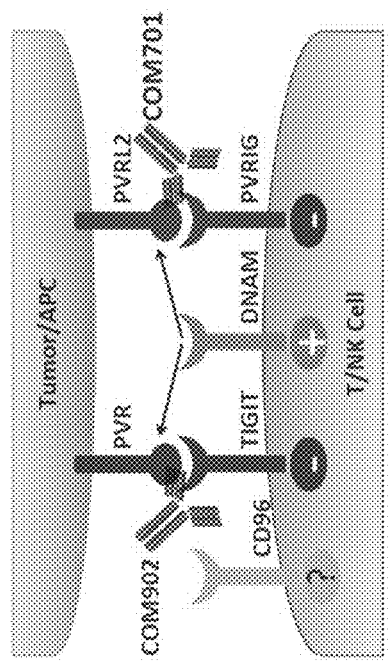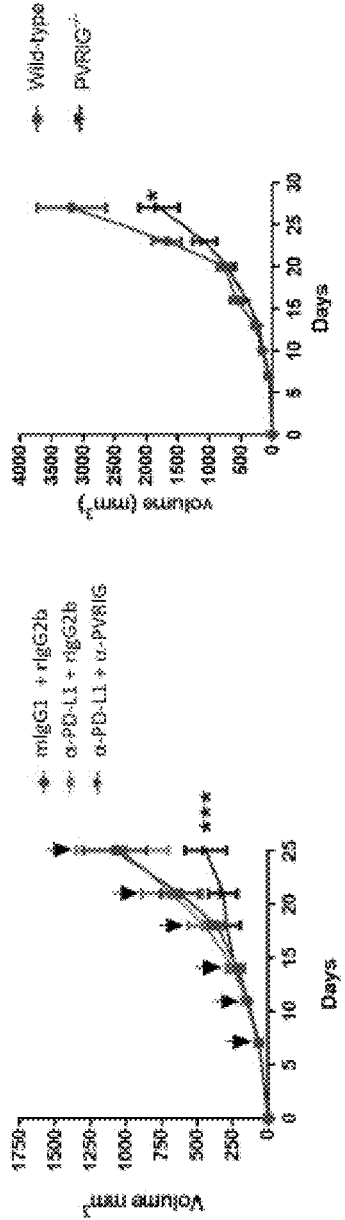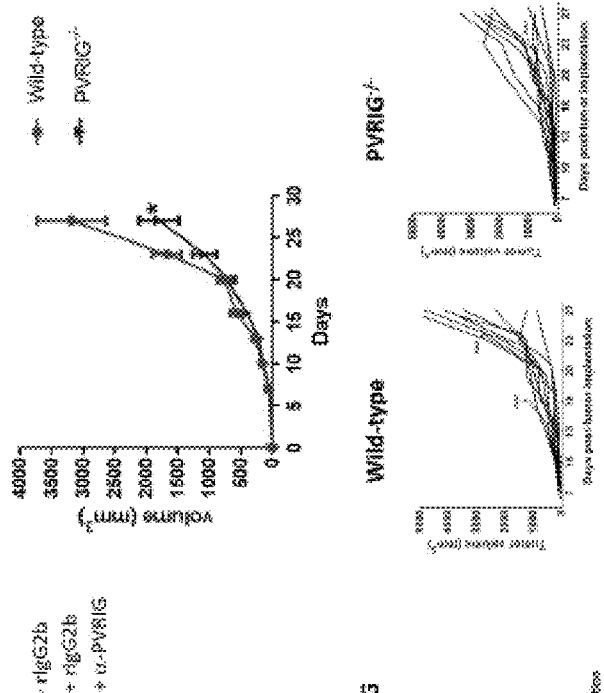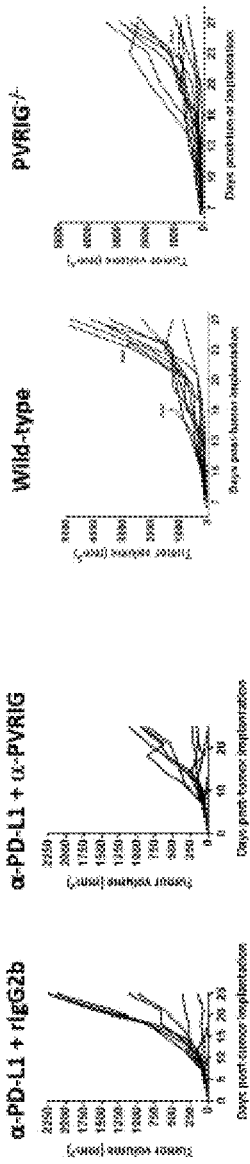
Figure 54

Figure 62A

From WO2017100541 (Medimmune, LLC; also US20170306025; Durvalumab)

| What | sequence | SEQ ID NO: |
|---|---|---|
| Heavy chain (SEQ ID NO:2 from WO2017100541) | EVQLVESGGGLVQPGGSLRLSCAASGFTFSRYWMSWVRQAPGKGLEWVANIKQDGSEKYYV DSVKGRFTISRDNAKNSLYLQMNSLRAEDTAVYYCAREGGWFGELAFDYWGQGTLVTVSS | 1117 |
| vhCDR1 (SEQ ID NO:3 from WO2017100541) | RYWMS | 1118 |
| vhCDR2 (SEQ ID NO:4 from WO2017100541) | NIKQDGSEKYYVDSVKG | 1119 |
| vhCDR3 (SEQ ID NO:5 from WO2017100541) | EGGWFGELAFD | 1120 |
| Light chain (SEQ ID NO:1 from WO2017100541) | EIVLTQSPGTLSLSPGERATLSCRASQRVSSSYLAWYQQKPGQAPRLLIYDASSRATGIPD RFSGSGSGTDFTLTISRLEPEDFAVYYCQQYGSLPWTFGQGTKVEIK | 1121 |
| vlCDR1 (SEQ ID NO:6 from WO2017100541) | RASQRVSSSYLA | 1122 |
| vlCDR2 (SEQ ID NO:7 from WO2017100541) | DASSRAT | 1123 |
| vlCDR3 (SEQ ID NO:8 from WO2017100541) | QQYGSLPWT | 1124 |

Figure 62B

From US20170281764 (JN Biosciences)

| What | sequence | SEQ ID NO: |
|---|---|---|
| Heavy chain (SEQ ID NO:34 from US2017281764) | EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG | 1125 |
| Light chain (SEQ ID NO:36 from US2017281764) | DIQMTQSPSSLSASVGDRVTITCRASQDVSTAVAWYQQKPGKAPKLLIYSASFLYSGVPSRFSGSGSGTDFTLTISSLQPEDFATYYCQQYLFTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1126 |

Figure 62C

From WO2015009856 (GENENTECH, INC. and F. HOFFMANN-LA ROCHE AG)

| What | sequence | SEQ ID NO: |
|---|---|---|
| Heavy chain (SEQ ID NO:23 from WO2015009856) | EVQLVESGGGLVQPGGSLRLSCAASGFTFSDSWIHWVRQAPGKGLEWVAWISPYGGST YYADSVKGRFTISADTSKNTAYLQMNSLRAEDTAVYYCARRHWPGGFDYWGQGTLVT VSA | 1127 |
| vhCDR1 (SEQ ID NO:17 from WO2015009856) | GFTFSDSWIH | 1128 |
| vhCDR2 (SEQ ID NO:18 from WO2015009856) | AWISPYGGSTYYADSVKG | 1129 |
| vhCDR3 (SEQ ID NO:19 from WO2015009856) | RHWPGGFDY | 1130 |
| Light chain (SEQ ID NO:24 from WO2015009856) | DIQMTQSPSSLSASVGDRVTITCRASQDVSTAVAWYQQKPGKAPKLLIYSASFLYSGVPS RFSGSGSGTDFTLTISSLQPEDFATYYCQQYLYHPATFGQGTKVEIKR | 1131 |
| vlCDR1 (SEQ ID NO:20 from WO2015009856) | RASQDVSTAVA | 1132 |
| vlCDR2 (SEQ ID NO:21 from WO2015009856) | SASFLYS | 1133 |
| vlCDR3 (SEQ ID NO:22 from WO2015009856) | QQYLYHPAT | 1134 |

Figure 62D

From WO2015009856 (GENENTECH, INC. and F. HOFFMANN-LA ROCHE AG)

| What | sequence | SEQ ID NO: |
|---|---|---|
| Heavy chain (SEQ ID NO: 40 from WO2015009856) | EVQLVESGGGLVQPGGSLRLSCAASGFTFSDSWIHWVRQAPGKGLEWVA WISPYGG STYY ADSVKGRFTISADTSKNTA YLQMNSLRAEDTA VYYCARRHWPGGFDYWGQG TLVTVSSASTK (SEQ ID N0:40), or | 1135 |
| Light chain (SEQ ID NO: 41 from WO2015009856) | DIQMTQSPSSLSASVGDRVTITCRASQDVSTA VA WYQQKPGKAPKLLIYSASFL YSG VPSRFSGSGSGTDFTLTISSLQPEDF ATYYCQQYL YHPATFGQGTKVEIKR (SEQ ID N0:24). | 1136 |

From WO2015009856 (GENENTECH, INC. and F. HOFFMANN-LA ROCHE AG)

| What | sequence | SEQ ID NO |
|---|---|---|
| Heavy chain (SEQ ID NO: 41 from WO2015009856) | EVQLVESGGGLVQPGGSLRLSCAASGFTFSDSWIHWVRQAPGKGLEWVAWISPYGG STYYADSVKGRFTISADTSKNTAYLQMNSLRAEDTA VYYCARRHWPGGFDYWGQG TLVTVSS | 1137 |
| Light chain (SEQ ID NO: from WO2015009856) | DIQMTQSPSSLSASVGDRVTITCRASQDVSTAVAWYQQKPGKAPKLLIYSASFLYSGVPS RFSGSGSGTDFTLTISSLQPEDFATYYCQQYLYHPATFGQGTKVEIKR | 1138 |

Figure 62E

From US20160222117 (GENENTECH, INC.)

| What | sequence | SEQ ID NO: |
|---|---|---|
| Heavy chain (SEQ ID NO:20 from US20160222117) | EVQLVESCGGLVQPGGSLRLSCAASGFTFSDSWIHWVRQAPGKGLEWVAWISPYGGST YYADSVKGRFTISRDTSKNTAYLQMNSLRAEDTAVYYCARRHWPGGFDYWGQGTLVT VSA | 1139 |
| Heavy chain (SEQ ID NO:23 from US20160222117) | EVQLVESGGGLVQPGGSLRLSCAASGFTFSDSWIHWVRQAPGKGLEWVAWISPYGGST YYADSVKGRFTISRDTSKNTAYLQMNSLRAEDTAVYYCARRHWPGGFDYWGQGTLVT VSA | 1140 |
| Heavy chain (SEQ ID NO:24 from US20160222117) | EVQLVESGGGLVQPGGSLRLSCAASGFTFSGSWIHWVRQAPGKGLEWVAWILPYGGSS YYADSVKGRFTISRDTSKNTAYLQMNSLRAEDTAVYYCARRHWPGGFDYWGQGTLVT VSA | 1141 |

From US20160222117 (GENENTECH, INC.)

| What | sequence | SEQ ID NO. |
|---|---|---|
| Light chain (SEQ ID NO:21 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYLYHPATFGQGTKVEIKR | 1142 |
| Light chain (SEQ ID NO:26 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYYNVPWTFGQGTKVEIKR | 1143 |
| Light chain (SEQ ID NO:27 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYYAPPWTFGQGTKVEIKR | 1144 |

Figure 62F

From US20160222117 (GENENTECH, INC.)

| What | sequence | SEQ ID NO: |
|---|---|---|
| Light chain (SEQ ID NO:28 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYYTVPWTFGQGTKVEIKR | 1145 |
| Light chain (SEQ ID NO:29 from US20160222117) | DIQMTQSPSSLSASVGDRVTITCRASQVINTFLAWYQQKPGKAPKLLIYSASTLASGVPS RFSGSGSGTDFTLTISSLQPEDFATYYCQQYYTVPRTFGQGTKVEIKR | 1146 |
| Light chain (SEQ ID NO:30 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQGYGVPRTFGQGTKVEIKR | 1147 |
| Light chain (SEQ ID NO:31 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYLFTPPTFGQGTKVEIKR | 1148 |
| Light chain (SEQ ID NO:32 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYFITPTFGQGTKVEIKR | 1149 |
| Light chain (SEQ ID NO:33 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYTPPTFGQGTKVEIKR | 1150 |
| Light chain (SEQ ID NO:34 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQFFYTPPTFGQGTKVEIKR | 1151 |

Figure 62G

From US20160222117 (GENENTECH, INC.)

| What | sequence | SEQ ID NO: |
|---|---|---|
| Light chain (SEQ ID NO:35 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQSLFTPPTFGQGTKVEIKR | 1152 |
| Light chain (SEQ ID NO:36 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQSLYTPPTFGQGTKVEIKR | 1153 |
| Light chain (SEQ ID NO:37 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQSWYHPPTFGQGTKVEIKR | 1154 |
| Light chain (SEQ ID NO:38 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYFYIPPTFGQGTKVEIKR | 1155 |
| Light chain (SEQ ID NO:39 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQYWYTPYTFGQGTKVEIKR | 1156 |
| Light chain (SEQ ID NO:40 from US20160222117) | DIQMTQSPSSLSASVGDRVTITCRASQDVSTAVAWYQQKPGKAPKLLIYSASFLYSGVPS RFSGSGSGTDFTLTISSLQPEDFATYYCQQSYFIPPTFGQGTKVEIKR | 1157 |

Figure 62H

| What | sequence | SEQ ID NO: |
|---|---|---|
| From WO2013079174 (Merck; Avelumab or A09-246-2) | | |
| Heavy chain (SEQ ID NO:32 from WO2013079174) | EVQLLESGGGLVQPGGSLRLSCAASGFTFSSYIMMWVRQAPGKGLEWVSSIYPSGGITFYADT VKGRFTISRDNSKNTLYLQMNSLRAEDTAVYYCARIKLGTVTTVDYWGQGTLVTVSSASTKG PSVFPLAPSSKSTSGGTAALGCLVKDYFPEPVTVSWNSGALTSGVHTFPAVLQSSGLYSLSSVV TVPSSSLGTQTYICNVNHKPSNTKVDKKVEPKSCDKTHTCPPCPAPELLGGPSVFLFPPKPKD TLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTKNQVSLTCLVKGF YPSDIAVEWESNGQPENNYKTTPPVLDSDGSFFLYSKLTVDKSRWQQGNVFSCSVMHEALH NHYTQKSLSLSPGK | 1158 |
| Light chain (SEQ ID NO: from WO2013079174) | QSALTQPASVSGSPGQSITISCTGTSSDVGGYNYVSWYQQHPGKAPKLMIYDVSNRPSGVSNR FSGSKSGNTASLTISGLQAEDEADYYCSSYTSSSTRVFGTGTKVTVLGQPKANPTVTLFPPSSEE LQANKATLVCLISDFYPGAVTVAWKADGSPVKAGVETTKPSKQSNNKYAASSYLSLTPEQW KSHRSYSCQVTHEGSTVEKTVAPTECS | 1159 |

Figure 62I

From US8217149 (Hoffman La Roche; Atezolizumab)

| What | sequence | SEQ ID NO: |
|---|---|---|
| Heavy chain (VH) (SEQ ID NO:20 from US8217149) | EVQLVESGGGLVQPGGSLRLSCAASGFTFSDSWIHWVRQAPGKGLEWVAWISPYGGSTYYA DSVKGRFTISADTSKNTAYLQMNSLRAEDTAVYYCARRHWPGGFDYWGQGTLVTVSA | 1160 |
| Light chain (VL) (SEQ ID NO:21 from US8217149) | DIQMTQSPSSLSASVGDRVTITCRASQDVSTAVAWYQQKPGKAPKWYSASFLYSGVPSRFSGS GSGTDFTLTISSLQPEDFATYC QQYLYH PATFGQGTKVEIKR | 1161 |

Atezolizumab (alternate sequence))

| What | sequence | SEQ ID NO: |
|---|---|---|
| Heavy chain (from IMGT database or DrugBank database) | EVQLVESGGGLVQPGGSLRLSCAASGFTFSDSWIHWVRQAPGKGLEWVAWISPYGGSTYYA DSVKGRFTISADTSKNTAYLQMNSLRAEDTAVYYCARRHWPGGFDYWGQGTLVTVSSASTK GPSVFPLAPSSKSTSGGTAALGCLVKDYFPEPVTVSWNSGALTSGVHTFPAVLQSSGLYSLSSV VTVPSSSLGTQTYICNVNHKPSNTKVDKKVEPKSCDKTHTCPPCPAPELLGGPSVFLFPPKPK DTLMISRTPEVTCVVVDVSHEDPEVKFNWYVDGVEVHNAKTKPREEQYASTYRVVSVLTVL HQDWLNGKEYKCKVSNKALPAPIEKTISKAKGQPREPQVYTLPPSREEMTKNQVSLTCLVKG FYPSDIAVEWESNGQPENNYKTTPPVLDSDGSFFLYSKLTVDKSRWQQGNVFSCSVMHEALH NHYTQKSLSLSPGK | 1162 |
| Light chain (from IMGT database or DrugBank database) | DIQMTQSPSSLSASVGDRVTITCRASQDVSTAVAWYQQKPGKAPKLLIYSASFLYSGVPSRFSG SGSGTDFTLTISSLQPEDFATYCQQYLYHPATFGQGTKVEIKRTVAAPSVFIFPPSDEQLKSGT ASVVCLLNNFYPREAKVQWKVDNALQSGNSQESVTEQDSKDSTYSLSSTLTLSKADYEKHKV YACEVTHQGLSSPVTKSFNRGEC | 1163 |

Figure 63A

CPA.7.001

| What | sequence | SEQ ID NO: |
|---|---|---|
| Variable heavy (vh) domain | QMQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEVSSPYGMDVWGQGTTVTVSS | 1164 |
| vhCDR1 | GGTFSSYA | 1165 |
| vhCDR2 | IIPIFGTA | 1166 |
| vhCDR3 | AREEVSSPYGMDV | 1167 |
| Full length HC | QMQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEVSSPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 1168 |
| Variable light (vl) domain | QAVVTQEPSLTVSPGGTVTLTCGTSTGAVTSGHYPYWFQQKPGQAPKTLIYDTGNKHSWTPARFSGSLLGGKAALTLSGAQPEDEADYYCLLSYSGASWVFGGGTKLTVLG | 1169 |
| vlCDR1 | TGAVTSGHY | 1170 |
| vlCDR2 | DTG | 1171 |
| vlCDR3 | LLSYSGASWV | 1172 |
| Full length light chain | QAVVTQEPSLTVSPGGTVTLTCGTSTGAVTSGHYPYWFQQKPGQAPKTLIYDTGNKHSWTPARFSGSLLGGKAALTLSGAQPEDEADYYCLLSYSGASWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 1173 |

Figure 63B
CPA.7.003

| What | sequence | SEQ ID NO: |
|---|---|---|
| Variable heavy (vh) domain | QVQLVQSGAEVKKPGASVKVSCKVSGFSLSHFSMHWVRQVPGKGLEWLGGFDPEEGGTIPAQKFQGRLTMTEDTST ETAYMELSSLRSEDTAVYYCATGIWYSSGWPVDYWGPGTLVTVSS | 1174 |
| vhCDR1 | GFSLSHFS | 1175 |
| vhCDR2 | FDPEEGGT | 1176 |
| vhCDR3 | ATGIWYSSGWPVDY | 1177 |
| Full length HC | EVQLVQSGAEVKKPGSSVKVSCKASGGTFSSYAISWVRQAPGQGLEWMGGIIPIFGTANYAQKFQGRVTITADKSTST AYMELSSLRSEDTAVYYCARGPWYYDSSGYSSYAYYMDVWGQGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1178 |
| Variable light (vl) domain | DVVMTQSPLSLPVTPGGPASISCRSSQSLLDSSGYNYVDWYLQKPGQSPQLLISLGSDRASGVPDRFSGSGSGTDFTLKI SRVEAEDVGIYYCMQALQTPITFGQGTRLEIKR | 1179 |
| vlCDR1 | QSLLDSSGYNY | 1180 |
| vlCDR2 | LGS | 1181 |
| vlCDR3 | MQALQTPIT | 1182 |
| Full length light chain | DVVMTQSPLSLPVTPGGPASISCRSSQSLLDSSGYNYVDWYLQKPGQSPQLLISLGSDRASGVPDRFSGSGSGTDFTLKI SRVEAEDVGIYYCMQALQTPITFGQGTRLEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEC | 1183 |

Figure 63C
CPA.7.004

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATVSRVRGVINYYYYMDV WGKGTTVTVSS | 1184 |
| vhCDR1 | GYTLTELS | 1185 |
| vhCDR2 | FDPEDGET | 1186 |
| vhCDR3 | ATVSRVRGVINYYYYMDV | 1187 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATVSRVRGVINYYYYMDVWGKGTTVTVSSASTKGPSVFPLAPSSKSTSGGTAALGCLV KDYFPEPVTVSWNSGALTSGVHTFPAVLQSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPGK | 1188 |
| Variable light (vl) domain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKR | 1189 |
| vlCDR1 | QSLLYRNGNNY | 1190 |
| vlCDR2 | LGS | 1191 |
| vlCDR3 | MQALQTPPT | 1192 |
| Full length light chain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1193 |

Figure 63D
CPA.7.006

| What | sequence | SEQ ID NO: |
|---|---|---|
| Variable heavy (vh) domain | QVQLVQSGAEVRRPGSSVRVSCKPSGGTFGTYAFTWVRQAPGQGLEWMGGITPISATINRAQNLQDRLTITADESTT TVHMDLTSLRSEDTAVYYCARGFEYSDGLLDDWGQGTLVTVSS | 1194 |
| vhCDR1 | GGTFGTYA | 1195 |
| vhCDR2 | ITPISATI | 1196 |
| vhCDR3 | ARGFEYSDGLLDD | 1197 |
| Full length HC | QVQLVQSGAEVRRPGSSVRVSCKPSGGTFGTYAFTWVRQAPGQGLEWMGGITPISATINRAQNLQDRLTITADESTT TVHMDLTSLRSEDTAVYYCARGFEYSDGLLDDWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAP ELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLSPGK | 1198 |
| Variable light (vl) domain | DIVMTQTPLSLPVIPGEPASISCRSSQSLFYSDDGNTYLDWYLQKPGQSPQLLIYRLSHRASGVPDRFSGSGSGTDFTLKI SRVEAEDVGVYYCMQHMEFPLTFGGGTKVEIKR | 1199 |
| vlCDR1 | QSLFYSDDGNTY | 1200 |
| vlCDR2 | RLS | 1201 |
| vlCDR3 | MQHMEFPLT | 1202 |
| Full length light chain | DIVMTQTPLSLPVIPGEPASISCRSSQSLFYSDDGNTYLDWYLQKPGQSPQLLIYRLSHRASGVPDRFSGSGSGTDFTLKI SRVEAEDVGVYYCMQHMEFPLTFGGGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 1203 |

Figure 63E
CPA.7.008

| What | sequence | SEQ ID NO: |
|---|---|---|
| Variable heavy (vh) domain | QVQLQESGPGLVKPSGTLSLTCVVSSGSISSTNWWTWVRQPPGKGLEWIGEIYHSGSTSYNSSLKSRVTISEDKSKNQIS LRLSSVTAADTAVYYCARVGPAAIYYWGQGTLVTVSS | 1204 |
| vhCDR1 | SGSISSTNW | 1205 |
| vhCDR2 | IYHSGST | 1206 |
| vhCDR3 | ARVGPAAIYY | 1207 |
| Full length HC | QVQLQESGPGLVKPSGTLSLTCVVSSGSISSTNWWTWVRQPPGKGLEWIGEIYHSGSTSYNSSLKSRVTISEDKSKNQIS LRLSSVTAADTAVYYCARVGPAAIYYWGQGTLVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVDKKVEPKSCDKTHTCPPCPAPELLGGPS VFLFPPKPKDTLMISRTPEVTCVVVDVSHEDPEVKFNWYVDGVEVHNAKTKPREEQYNSTYRVVSVLTVLHQDWLNG KEYKCKVSNKALPAPIEKTISKAKGQPREPQVYTLPPSREEMTKNQVSLTCLVKGFYPSDIAVEWESNGQPENNYKTPP VLDSDGSFFLYSKLTVDKSRWQQGNVFSCSVMHEALHNHYTQKSLSLSPGK | 1208 |
| Variable light (vl) domain | QAGLTQPPSVSKGLRQTATLTCTGNSNNVGYEGAAWLQQHQGHAPKLLLYRNNNRPSGISKRFSASRSGNTASLTITG LQPEDEADYYCSAWDSSLNAVVFGGGTQLTVLG | 1209 |
| vlCDR1 | SNNVGYEG | 1210 |
| vlCDR2 | RNN | 1211 |
| vlCDR3 | SAWDSSLNAVV | 1212 |
| Full length light chain | QAGLTQPPSVSKGLRQTATLTCTGNSNNVGYEGAAWLQQHQGHAPKLLLYRNNNRPSGISKRFSASRSGNTASLTITG LQPEDEADYYCSAWDSSLNAVVFGGGTQLTVLGQPKAAPSVTLFPPSSEELQANKATLVCLISDFYPGAVTVAWKADS SPVKAGVETTTPSKQSNNKYAASSYLSLTPEQWKSHRSYSCQVTHEGSTVEKTVAPTECS | 1213 |

Figure 63F
CPA.7.009

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATAKPGIAVAGQNYYYYMDVWGKGTTVTVSS | 1214 |
| vhCDR1 | GYTLTELS | 1215 |
| vhCDR2 | FDPEDGET | 1216 |
| vhCDR3 | ATAKPGIAVAGQNYYYYMDV | 1217 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATAKPGIAVAGQNYYYYMDVWGKGTTVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKSCD KTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIAV EWESNGQPENNYKTTPPVLDSDGSFFLYSKLTVDKSRWQQGNVFSCSVMHEALHNHYTQKSLSLSPGK | 1218 |
| Variable light (vl) domain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKR | 1219 |
| vlCDR1 | QSLLYRNGNNY | 1220 |
| vlCDR2 | LGS | 1221 |
| vlCDR3 | MQALQTPPT | 1222 |
| Full length light chain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1223 |

Figure 63G
CPA.7.010

| What | sequence | SEQ ID NO: |
|---|---|---|
| Variable heavy (vh) domain | EVQLVESGGGLVQPGRSLRLSCAASGFTFSSYAMHWVRQAPGKGLEWVAVISYDGSNKYYADSVKGRFTISRDNSKN TLYLQMNSLRAEDTAVYYCASSPIGYSYGYWGGMDVWGQGTTVTVSS | 1224 |
| vhCDR1 | GFTFSSYA | 1225 |
| vhCDR2 | ISYDGSNK | 1226 |
| vhCDR3 | ASSPIGYSYGYWGGMDV | 1227 |
| Full length HC | EVQLVESGGGLVQPGRSLRLSCAASGFTFSSYAMHWVRQAPGKGLEWVAVISYDGSNKYYADSVKGRFTISRDNSKN TLYLQMNSLRAEDTAVYYCASSPIGYSYGYWGGMDVWGQGTTVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKKVEPKSCDKTHTCP PCPAPELLGGPSVFLFPPKPKDTLMISRTPEVTCVVVDVSHEDPEVKFNWYVDGVEVHNAKTKPREEQYNSTYRVVSVL TVLHQDWLNGKEYKCKVSNKALPAPIEKTISKAKGQPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 1228 |
| Variable light (vl) domain | QAVLTQPASLSASPGASASLTCTLRSGIDVRTNKIFWYQVKPGSPPQHLLTFQSDSDKQQGSGVPSRFSGSKDASANA GILIISGLQSEDEADYYCLIWHTSGWVFGGGTQLTVLG | 1229 |
| vlCDR1 | SGIDVRTNK | 1230 |
| vlCDR2 | FQSDSDK | 1231 |
| vlCDR3 | LIWHTSGWV | 1232 |
| Full length light chain | QAVLTQPASLSASPGASASLTCTLRSGIDVRTNKIFWYQVKPGSPPQHLLTFQSDSDKQQGSGVPSRFSGSKDASANA GILIISGLQSEDEADYYCLIWHTSGWVFGGGTQLTVLGQPKAAPSVTLFPPSSEELQANKATLVCLISDFYPGAVTVAWK ADSSPVKAGVETTTPSKQSNNKYAASSYLSLTPEQWKSHRSYSCQVTHEGSTVEKTVAPTECS | 1233 |

Figure 63H
CPA.7.011

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGPAAAGVGYYYMDV WGKGTTVTVSS | 1234 |
| vhCDR1 | GYTLTELS | 1235 |
| vhCDR2 | FDPEDGET | 1236 |
| vhCDR3 | ATGPAAAGVGYYYMDV | 1237 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGPAAAGVGYYYMDVWGKGTTVTVSSASTKGPSVFPLAPSSKSTSGGTAALGCLV KDYFPEPVTVSWNSGALTSGVHTFPAVLQSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPGK | 1238 |
| Variable light (vl) domain | DVVMTQSPLSLPVTPGEPASISCRSSQSLLYRNGYNYLDWYLQKPGQSPQLLIYLGSNRASGVPDRFSGSGSGTDFTLKI SRVEAEDVGVYYCMQALQTPPTFGQGTKVEIKR | 1239 |
| vlCDR1 | QSLLYRNGYNY | 1240 |
| vlCDR2 | LGS | 1241 |
| vlCDR3 | MQALQTPPT | 1242 |
| Full length light chain | DVVMTQSPLSLPVTPGEPASISCRSSQSLLYRNGYNYLDWYLQKPGQSPQLLIYLGSNRASGVPDRFSGSGSGTDFTLKI SRVEAEDVGVYYCMQALQTPPTFGQGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1243 |

Figure 63I
CPA7.012

| What | sequence | SEQ ID NO: |
|---|---|---|
| Variable heavy (vh) domain | EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDVMVYCSSTSCYFYGMDVWGQGTTVTVSS | 1244 |
| vhCDR1 | GFTFSSYA | 1245 |
| vhCDR2 | ISYDGSNK | 1246 |
| vhCDR3 | ARDVMVYCSSTSCYFYGMDV | 1247 |
| Full length HC | EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDVMVYCSSTSCYFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 1248 |
| Variable light (vl) domain | DIQMTQSPSSLSASVGDRVTVTCQASQDIRDYLNWYQKKPGKAPKLLIYDASNLEAGVPSRFSGSGSGTDFTFTISGLQPEDVATYYCQQFENLPITFGQGTRLEIKR | 1249 |
| vlCDR1 | QDIRDY | 1250 |
| vlCDR2 | DAS | 1251 |
| vlCDR3 | QQFENLPIT | 1252 |
| Full length light chain | DIQMTQSPSSLSASVGDRVTVTCQASQDIRDYLNWYQKKPGKAPKLLIYDASNLEAGVPSRFSGSGSGTDFTFTISGLQPEDVATYYCQQFENLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1253 |

Figure 63J
CPA.7.013

| What | sequence | SEQ ID NO: |
|---|---|---|
| Variable heavy (vh) domain | QVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGGYSSGFNYYYYYMDV WGKGTTVTVSS | 1254 |
| vhCDR1 | GYTLTELS | 1255 |
| vhCDR2 | FDPEDGET | 1256 |
| vhCDR3 | ATGGYSSGFNYYYYYMDV | 1257 |
| Full length HC | QVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATGGYSSGFNYYYYYMDVWGKGTTVTVSSASTKGPSVFPLAPSSKSTSGGTAALGCLV KDYFPEPVTVSWNSGALTSGVHTFPAVLQSSGLYSLSSVVTVPSSSLGTQTYICNVNHKPSNTKVDKKVEPKSCDKTHTC PPCPAPELLGGPSVFLFPPKPKDTLMISRTPEVTCVVVDVSHEDPEVKFNWYVDGVEVHNAKTKPREEQYNSTYRVVS VLTVLHQDWLNGKEYKCKVSNKALPAPIEKTISKAKGQPREPQVYTLPPSREEMTKNQVSLTCLVKGFYPSDIAVEWES NGQPENNYKTTPPVLDSDGSFFLYSKLTVDKSRWQQGNVFSCSVMHEALHNHYTQKSLSLSPGK | 1258 |
| Variable light (vl) domain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKR | 1259 |
| vlCDR1 | QSLLYRNGNNY | 1260 |
| vlCDR2 | LGS | 1261 |
| vlCDR3 | MQALQTPPT | 1262 |
| Full length light chain | DVVMTQSPLSLPVTPGEPASISCRSSQSLLYRNGNNYLDWYLQKPGQSPQLLIYLGSNRASGVPDRFSGSGSGTDFTLKI SRVEAEDVGVYYCMQALQTPPTFGGGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1263 |

Figure 63K
CPA.7.014

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVTTYYYGMDVWGQGTTVTVSS | 1264 |
| vhCDR1 | GYTLTELS | 1265 |
| vhCDR2 | FDPEDGET | 1266 |
| vhCDR3 | ATGVTTYYYGMDV | 1267 |
| Full length HC | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVTTYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 1268 |
| Variable light (vl) domain | DVVMTQSPLSLPVTPGEPASISCRSSQSLLYSNGNNFLDWYLQKPGQSPRLLISLGSNRASGVPDRFSGSGSGTDFTLKISRVEAEDVGIYYCMQALQTPPTFGQGTKVEIKR | 1269 |
| vlCDR1 | QSLLYSNGNNF | 1270 |
| vlCDR2 | LGS | 1271 |
| vlCDR3 | MQALQTPPT | 1272 |
| Full length light chain | DVVMTQSPLSLPVTPGEPASISCRSSQSLLYSNGNNFLDWYLQKPGQSPRLLISLGSNRASGVPDRFSGSGSGTDFTLKISRVEAEDVGIYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1273 |

Figure 63L
CPA.7.015

| What | sequence | SEQ ID NO: |
|---|---|---|
| Variable heavy (vh) domain | QITLKESGGGVVQPGGSLRLSCAASGFTFSSYGMHWVRQAPGKGLEWVAFIRYDGSNKYYADSVKGRFTISRDNSKN TLYLQMNSLRAEDTAVYYCARDLFDFWWDGMDVWGQGTTVTVSS | 1274 |
| vhCDR1 | GFTFSSYG | 1275 |
| vhCDR2 | IRYDGSNK | 1276 |
| vhCDR3 | ARDLFDFWWDGMDV | 1277 |
| Full length HC | QITLKESGGGVVQPGGSLRLSCAASGFTFSSYGMHWVRQAPGKGLEWVAFIRYDGSNKYYADSVKGRFTISRDNSKN TLYLQMNSLRAEDTAVYYCARDLFDFWWDGMDVWGQGTTVTVSSASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTHTCPPC PAPELLGGPSVFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK | 1278 |
| Variable light (vl) domain | EIVLTQSPGTLSLSPGEKATLSCRVSQSVSSMYLAWYQQKPGQAPRLLIYGASYRATGIPDRFSGSGSGTDFNLTISRLEP EDFAVYYCQQYVSSPMYTFGLGTKLEIKR | 1279 |
| vlCDR1 | QSVSSMY | 1280 |
| vlCDR2 | GAS | 1281 |
| vlCDR3 | QQYVSSPMYT | 1282 |
| Full length light chain | EIVLTQSPGTLSLSPGEKATLSCRVSQSVSSMYLAWYQQKPGQAPRLLIYGASYRATGIPDRFSGSGSGTDFNLTISRLEP EDFAVYYCQQYVSSPMYTFGLGTKLEIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRGEC | 1283 |

Figure 63M
CPA.7.017

| What | sequence | SEQ ID NO: |
|---|---|---|
| Variable heavy (vh) domain | QVQLVQSGAEVKKPGSSVKVSCKASGGTFNNYGISWVRQAPGKGLEWMGQIIPLFGTTKYAQKFQGRVTIAADEPTS TAYMELGSLRSEDTAIYYCARDRMAADGMAVFDYWGQGTLVTVSS | 1284 |
| vhCDR1 | GGTFNNYG | 1285 |
| vhCDR2 | IIPLFGTT | 1286 |
| vhCDR3 | ARDRMAADGMAVFDY | 1287 |
| Full length HC | QVQLVQSGAEVKKPGSSVKVSCKASGGTFNNYGISWVRQAPGKGLEWMGQIIPLFGTTKYAQKFQGRVTIAADEPTS TAYMELGSLRSEDTAIYYCARDRMAADGMAVFDYWGQGTLVTVSSASTKGPSVFPLAPSSKSTSGGTAALGCLVKDYF PEPVTVSWNSGALTSGVHTFPAVLQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVHNAKTKPREEQYNSTYRVVSVLTVL HQDWLNGKEYKCKVSNKALPAPIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSLSPGK | 1288 |
| Variable light (vl) domain | QSVLTQPPSVSGTPGQKVIISCSGSSSNIGRHFVFWYQQLPGTAPKLLIYKNDERPSGVPDRFSGSKSGTSASLAVSGLRS EDEADYYCSSWDAALNGVVFGGGTKLTVLG | 1289 |
| vlCDR1 | SSNIGRHF | 1290 |
| vlCDR2 | KND | 1291 |
| vlCDR3 | SSWDAALNGVV | 1292 |
| Full length light chain | QSVLTQPPSVSGTPGQKVIISCSGSSSNIGRHFVFWYQQLPGTAPKLLIYKNDERPSGVPDRFSGSKSGTSASLAVSGLRS EDEADYYCSSWDAALNGVVFGGGTKLTVLGQPKAAPSVTLFPPSSEELQANKATLVCLISDFYPGAVTVAWKADSSPV KAGVETTTPSKQSNNKYAASSYLSLTPEQWKSHRSYSCQVTHEGSTVEKTVAPTECS | 1293 |

Figure 63N
CPA.7.018

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVPMVRGARRYYYYMDVWGKGTTVTVSS | 1294 |
| vhCDR1 | GYTLTELS | 1295 |
| vhCDR2 | FDPEDGET | 1296 |
| vhCDR3 | ATEVPMVRGARRYYYYMDV | 1297 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVPMVRGARRYYYYMDVWGKGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1298 |
| Variable light (vl) domain | DVVMTQSPLFLAVTPGEPASISCRSSQTLLYINENNYLDWYVQKPGQSPQLLIYLGSTRASGVPDRFSGGGSGTDFTLTI SRVEAEDVGLYYCMQGLQTPPTFGQGTRLEIKR | 1299 |
| vlCDR1 | QTLLYINENNY | 1300 |
| vlCDR2 | LGS | 1301 |
| vlCDR3 | MQGLQTPPT | 1302 |
| Full length light chain | DVVMTQSPLFLAVTPGEPASISCRSSQTLLYINENNYLDWYVQKPGQSPQLLIYLGSTRASGVPDRFSGGGSGTDFTLTI SRVEAEDVGLYYCMQGLQTPPTFGQGTRLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1303 |

Figure 63O
CPA.7.019

| What | sequence | SEQ ID NO: |
|---|---|---|
| Variable heavy (vh) domain | QVQLQESGPGLVKSSETLSLTCSVSGGSISNSNYYWGWIRQPPGKGLEWIGGIYYSGSTYYNPSLESRVTISEDTSKNQIS LKLSSVTAADTAVYYCARGAWELSLGDWFDPWGPGTLVTVSS | 1304 |
| vhCDR1 | GGSISNSNYY | 1305 |
| vhCDR2 | IYYSGST | 1306 |
| vhCDR3 | ARGAWELSLGDWFDP | 1307 |
| Full length HC | QVQLQESGPGLVKSSETLSLTCSVSGGSISNSNYYWGWIRQPPGKGLEWIGGIYYSGSTYYNPSLESRVTISEDTSKNQIS LKLSSVTAADTAVYYCARGAWELSLGDWFDPWGPGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAP ELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLSPGK | 1308 |
| Variable light (vl) domain | QSVLTQPPSVSGAPGQRVTISCTGSSSNIGAGYDIQWYQQLPGTAPKLLIYGNNNRPSGVPDRFSGSRSGTSASLAITGL QAEDEADYYCQSYDSSLSVYVVFGGGTQLTVLG | 1309 |
| vlCDR1 | SSNIGAGYD | 1310 |
| vlCDR2 | GNN | 1311 |
| vlCDR3 | QSYDSSLSVYVV | 1312 |
| Full length light chain | QSVLTQPPSVSGAPGQRVTISCTGSSSNIGAGYDIQWYQQLPGTAPKLLIYGNNNRPSGVPDRFSGSRSGTSASLAITGL QAEDEADYYCQSYDSSLSVYVVFGGGTQLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS | 1313 |

Figure 63P CPA.7.021

| What | sequence | SEQ ID NO: |
|---|---|---|
| Variable heavy (vh) domain | EVQLVESGGGVVKPGGSLRLSCAASGFTFGTSSMNWVRQAPGKGLEWVAVISFDGTEIHYADSVKGRFTISRDNSKST VFLQMNSLRPDDTALYYCAKGSGNIYFYSGMDVWGQGTTVTVSS | 1314 |
| vhCDR1 | GFTFGTSS | 1315 |
| vhCDR2 | ISFDGTEI | 1316 |
| vhCDR3 | AKGSGNIYFYSGMDV | 1317 |
| Full length HC | EVQLVESGGGVVKPGGSLRLSCAASGFTFGTSSMNWVRQAPGKGLEWVAVISFDGTEIHYADSVKGRFTISRDNSKST VFLQMNSLRPDDTALYYCAKGSGNIYFYSGMDVWGQGTTVTVSSASTKGPSVFPLAPSSKSTSGGTAALGCLVKDYFP EPVTVSWNSGALTSGVHTFPAVLQSSGLYSLSSVVTVPSSSLGTQTYICNVNHKPSNTKVDKKVEPKSCDKTHTCPPCP APELLGGPSVFLFPPKPKDTLMISRTPEVTCVVVDVSHEDPEVKFNWYVDGVEVHNAKTKPREEQYNSTYRVVSVLTVL HQDWLNGKEYKCKVSNKALPAPIEKTISKAKGQPREPQVYTLPPSREEMTKNQVSLTCLVKGFYPSDIAVEWESNGQP ENNYKTTPPVLDSDGSFFLYSKLTVDKSRWQQGNVFSCSVMHEALHNHYTQKSLSLSPGK | 1318 |
| Variable light (vl) domain | DIQMTQSPSTLSASVGDRVTITCRAGQSISGWLAWFQQKPGKAPNLLIYETSTLESGVPSRFSGSGSGTEYTLTISSLQP DDFATYYCQQYYSYPLTFGQGTKVEIKR | 1319 |
| vlCDR1 | QSISGW | 1320 |
| vlCDR2 | ETS | 1321 |
| vlCDR3 | QQYYSYPLT | 1322 |
| Full length light chain | DIQMTQSPSTLSASVGDRVTITCRAGQSISGWLAWFQQKPGKAPNLLIYETSTLESGVPSRFSGSGSGTEYTLTISSLQP DDFATYYCQQYYSYPLTFGQGTKVEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 1323 |

Figure 63Q
CAP.7.022

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYMDVWGKGTTVTVSS | 1324 |
| vhCDR1 | GYTLTELS | 1325 |
| vhCDR2 | FDPEDGET | 1326 |
| vhCDR3 | ATGVPAAIGVYYYYYMDV | 1327 |
| Full length HC | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 1328 |
| Variable light (vl) domain | DVVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQSPVTFGGGTKVEIKR | 1329 |
| vlCDR1 | QSLLYSNGYNY | 1330 |
| vlCDR2 | LGS | 1331 |
| vlCDR3 | MQALQSPVT | 1332 |
| Full length light chain | DVVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQSPVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1333 |

Figure 63R
CPA.7.023

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATDSRDGPAARGGYYYYMDVWGQGTTVTVSS | 1334 |
| vhCDR1 | GYTLTELS | 1335 |
| vhCDR2 | FDPEDGET | 1336 |
| vhCDR3 | ATDSRDGPAARGGYYYYMDV | 1337 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATDSRDGPAARGGYYYYMDVWGQGTTVTVSSASTKGPSVFPLAPSSKSTSGGTAALG CLVKDYFPEPVTVSWNSGALTSGVHTFPAVLQSSGLYSLSSVVTVPSSSLGTQTYICNVNHKPSNTKVDKKVEPKSCDKT HTCPPCPAPELLGGPSVFLFPPKPKDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYTLPPSREEMTKNQVSLTCLVKGFYPSDIAVE WESNGQPENNYKTTPPVLDSDGSFFLYSKLTVDKSRWQQGNVFSCSVMHEALHNHYTQKSLSLSPGK | 1338 |
| Variable light (vl) domain | DVVMTQSPLSLPVTLGQPASISCRSSQSLLYINGYNYLDWYLQKPGQSPQLLIYLGSNRASGVPDRFSGSGSGTDFTLKI SRVEAEDVGVYYCMQALQTPPTFGQGTKVEIKR | 1339 |
| vlCDR1 | QSLLYINGYNY | 1340 |
| vlCDR2 | LGS | 1341 |
| vlCDR3 | MQALQTPPT | 1342 |
| Full length light chain | DVVMTQSPLSLPVTLGQPASISCRSSQSLLYINGYNYLDWYLQKPGQSPQLLIYLGSNRASGVPDRFSGSGSGTDFTLKI SRVEAEDVGVYYCMQALQTPPTFGQGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1343 |

Figure 63S
CPA.7.024

| What | sequence | SEQ ID NO: |
|---|---|---|
| Variable heavy (vh) domain | EVQLVQSGAEVKKPGSSVKVSCKASGGTFSSYAISWVRQAPGQGLEWMGGIIPIFGTANYAQKFQGRVTITADESTST AYMELSSLRSEDTAVYYCARDAYYYDSSGYYNPDAFDIWGQGTMVTVSS | 1344 |
| vhCDR1 | GGTFSSYA | 1345 |
| vhCDR2 | IIPIFGTA | 1346 |
| vhCDR3 | ARDAYYYDSSGYYNPDAFDI | 1347 |
| Full length HC | EVQLVQSGAEVKKPGSSVKVSCKASGGTFSSYAISWVRQAPGQGLEWMGGIIPIFGTANYAQKFQGRVTITADESTST AYMELSSLRSEDTAVYYCARDAYYYDSSGYYNPDAFDIWGQGTMVTVSSASTKGPSVFPLAPSSKSTSGGTAALGCLVK DYFPEPVTVSWNSGALTSGVHTFPAVLQSSGLYSLSSVVTVPSSSLGTQTYICNVNHKPSNTKVDKKVEPKSCDKTHTCP PCPAPELLGGPSVFLFPPKPKDTLMISRTPEVTCVVVDVSHEDPEVKFNWYVDGVEVHNAKTKPREEQYNSTYRVVSVL TVLHQDWLNGKEYKCKVSNKALPAPIEKTISKAKGQPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 1348 |
| Variable light (vl) domain | DVVMTQSPLSLPVTPGEPASISCRSSQSLLHSNGYNYLDWYLQKPGQSPQLLIYLGSSRASGVPDRFSGSVSGTDFTLKI SRVEAEDVGVYYCMQGLQTPRTFGRGTKLEIKR | 1349 |
| vlCDR1 | QSLLHSNGYNY | 1350 |
| vlCDR2 | LGS | 1351 |
| vlCDR3 | MQGLQTPRT | 1352 |
| Full length light chain | DVVMTQSPLSLPVTPGEPASISCRSSQSLLHSNGYNYLDWYLQKPGQSPQLLIYLGSSRASGVPDRFSGSVSGTDFTLKI SRVEAEDVGVYYCMQGLQTPRTFGRGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1353 |

Figure 63T

CPA.7.033

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDTARRVRGVPYYYYAMDVWGQGTTVTVSS | 1354 |
| vhCDR1 | GGTFSSSA | 1355 |
| vhCDR2 | IIPIYGIT | 1356 |
| vhCDR3 | ARDDTARRVRGVPYYYYAMDV | 1357 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1358 |
| Variable light (vl) domain | ETTLTQSPAFMSATPGDEVNISCKASQDIDDDVSWYQQKPGGAPIFLIQEASTLVPGIPPRFSGSGFGTDFTLTIKNMES EDAAYYFCLQHDNLPLTFGGGTKVDIKR | 1359 |
| vlCDR1 | QDIDDD | 1360 |
| vlCDR2 | EAS | 1361 |
| vlCDR3 | LQHDNLPLT | 1362 |
| Full length light chain | ETTLTQSPAFMSATPGDEVNISCKASQDIDDDVSWYQQKPGGAPIFLIQEASTLVPGIPPRFSGSGFGTDFTLTIKNMES EDAAYYFCLQHDNLPLTFGGGTKVDIKRTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFNRGEC | 1363 |

Figure 63U

CPA.7.034

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEDPGPVAGPYYYGMDVWGQGTTVTVSS | 1364 |
| vhCDR1 | GYTLTELS | 1365 |
| vhCDR2 | FDPEDGET | 1366 |
| vhCDR3 | ATEDPGPVAGPYYYGMDV | 1367 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEDPGPVAGPYYYGMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1368 |
| Variable light (vl) domain | DVVMTQSPLVLPVTPGEPASISCRSSQSLLYINGYHYLDWYVQRPGQSPQLLIFLGSTRASGVPDRFSGSGSGTDFTLEIS KVEAEDVGIYFCMQALQTPPTFGGGTKVEIKR | 1369 |
| vlCDR1 | QSLLYINGYHY | 1370 |
| vlCDR2 | LGS | 1371 |
| vlCDR3 | MQALQTPPT | 1372 |
| Full length light chain | DVVMTQSPLVLPVTPGEPASISCRSSQSLLYINGYHYLDWYVQRPGQSPQLLIFLGSTRASGVPDRFSGSGSGTDFTLEIS KVEAEDVGIYFCMQALQTPPTFGGGTKVEIKRTVAAPSVFIFPPSDEQLKSGTASVVCLLNNFYPREAKVQWKVDNAL QSGNSQESVTEQDSKDSTYSLSSTLTLSKADYEKHKVYACEVTHQGLSSPVTKSFNRGEC | 1373 |

Figure 63V

CPA.7.036

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSLTSEDTAVYYCARDTARRVRGVPYYYYAMDVWGQGTTVTVSS | 1374 |
| vhCDR1 | GGTFSSSA | 1375 |
| vhCDR2 | IIPIYGIT | 1376 |
| vhCDR3 | ARDDTARRVRGVPYYYYAMDV | 1377 |
| Full length HC | QVQLVQSGAEVKKPGSSVKVSCKASGGTFSSSAISWVRQAPGQGFEWMGGIIPIYGITDYAQKFQGRVTITTDESTST AYMELSLTSEDTAVYYCARDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1378 |
| Variable light (vl) domain | DIVMTQTPLSLPVTPGEPASISCRPSQSLLDSDDGNTYLDWYLQKPGQSPQLLIHTLSYRASGVPDRFSGSGSGTDFTLKI SRVEAEDVGVYYCMQRLQFPLTFGGGTKVEIKR | 1379 |
| vlCDR1 | QSLLDSDDGNTY | 1380 |
| vlCDR2 | TLS | 1381 |
| vlCDR3 | MQRLQFPLT | 1382 |
| Full length light chain | DIVMTQTPLSLPVTPGEPASISCRPSQSLLDSDDGNTYLDWYLQKPGQSPQLLIHTLSYRASGVPDRFSGSGSGTDFTLKI SRVEAEDVGVYYCMQRLQFPLTFGGGTKVEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1383 |

Figure 63W

CPA.7.040

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYMDVWGKGTTVTVSS | 1384 |
| vhCDR1 | GYTLTELS | 1385 |
| vhCDR2 | FDPEDGET | 1386 |
| vhCDR3 | ATGVPAAIGVYYYYYMDV | 1387 |
| Full length HC | EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 1388 |
| Variable light (vl) domain | DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVDIKR | 1389 |
| vlCDR1 | QSLLYRNGYNY | 1390 |
| vlCDR2 | WGS | 1391 |
| vlCDR3 | MQAVQNPPT | 1392 |
| Full length light chain | DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1393 |

Figure 63X

CPA.7.046

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSLLTSEDTAVYYCARDTARRVRGVPYYYYAMDVWGQGTTVTVSS | 1394 |
| vhCDR1 | GGTFSSSA | 1395 |
| vhCDR2 | IIPIYGIT | 1396 |
| vhCDR3 | ARDDTARRVRGVPYYYYAMDV | 1397 |
| Full length HC | QVQLVQSGAEVKKPGSSVKVSCKASGGTFSSSAISWVRQAPGQGFEWMGGIIPIYGITDYAQKFQGRVTITTDESTST AYMELSLLTSEDTAVYYCARDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1398 |
| Variable light (vl) domain | DVVMTQSPAFLSVTPGERVTLSCKASQTMNNYLAWYQQKPGQAPRLLIYDASTRATDTPPRFSGSGSGTEFTLTISSV QSEDFALYYCQQYGDWLPITFGQGTRLEIKR | 1399 |
| vlCDR1 | QTMNNY | 1400 |
| vlCDR2 | DAS | 1401 |
| vlCDR3 | QQYGDWLPIT | 1402 |
| Full length light chain | DVVMTQSPAFLSVTPGERVTLSCKASQTMNNYLAWYQQKPGQAPRLLIYDASTRATDTPPRFSGSGSGTEFTLTISSV QSEDFALYYCQQYGDWLPITFGQGTRLEIKRTVAAPSVFIFPPSDEQLKSGTASVVCLLNNFYPREAKVQWKVDNALQS GNSQESVTEQDSKDSTYSLSSTLTLSKADYEKHKVYACEVTHQGLSSPVTKSFNRGEC | 1403 |

Figure 63Y

CPA.7.047

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATAFPEATISYYYYMDVWGKGTTVTVSS | 1404 |
| vhCDR1 | GYTLTELS | 1405 |
| vhCDR2 | FDPEDGET | 1406 |
| vhCDR3 | ATAFPEATISYYYYMDV | 1407 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATAFPEATISYYYYMDVWGKGTTVTVSSASTKGPSVFPLAPSSKSTSGGTAALGCLVKD YFPEPVTVSWNSGALTSGVHTFPAVLQSSGLYSLSSVVTVPSSSLGTQTYICNVNHKPSNTKVDKKVEPKSCDKTHTCPP CPAPELLGGPSVFLFPPKPKDTLMISRTPEVTCVVVDVSHEDPEVKFNWYVDGVEVHNAKTKPREEQYNSTYRVVSVLT VLHQDWLNGKEYKCKVSNKALPAPIEKTISKAKGQPREPQVYTLPPSREEMTKNQVSLTCLVKGFYPSDIAVEWESNG QPENNYKTTPPVLDSDGSFFLYSKLTVDKSRWQQGNVFSCSVMHEALHNHYTQKSLSLSPGK | 1408 |
| Variable light (vl) domain | DVVMTQSPLSLPVTPGEPASISCRSSQSLLYRNGYNYLDWYLQKPGQSPQLLIYWGSYRASGVPDRFSGSGSGTDFTLK ISRVEAEDVGVYYCMQAVQNPPTFGQGTKVEIKR | 1409 |
| vlCDR1 | QSLLYRNGYNY | 1410 |
| vlCDR2 | WGS | 1411 |
| vlCDR3 | MQAVQNPPT | 1412 |
| Full length light chain | DVVMTQSPLSLPVTPGEPASISCRSSQSLLYRNGYNYLDWYLQKPGQSPQLLIYWGSYRASGVPDRFSGSGSGTDFTLK ISRVEAEDVGVYYCMQAVQNPPTFGQGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 1413 |

Figure 63Z

CPA.7.049

| What | sequence | SEQ ID NO: |
|---|---|---|
| Variable heavy (vh) domain | QMQLVQSGAEVKKPGSSVKVSCKASGGTFSSSAISWVRQAPGQGFEWMGGIIPIYGITDYAQKFQGRVTITTDESTST AYMELSLTSEDTAVYYCARDDTARRVRGVPYYYYAMDVWGQGTTVTVSS | 1414 |
| vhCDR1 | GGTFSSSA | 1415 |
| vhCDR2 | IIPIYGIT | 1416 |
| vhCDR3 | ARDDTARRVRGVPYYYYAMDV | 1417 |
| Full length HC | QMQLVQSGAEVKKPGSSVKVSCKASGGTFSSSAISWVRQAPGQGFEWMGGIIPIYGITDYAQKFQGRVTITTDESTST AYMELSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1418 |
| Variable light (vl) domain | DIVMTQTPLSLPVTPGEPASMSCRSSRSLLDSDDGNTHLDWYLQKPGQSPQLLIQSLSYRASGVPDRFSGSGSGTDFTL EISRVEAEDVGIYYCMQRKEFPLTFGGGTKVEIKR | 1419 |
| vlCDR1 | RSLLDSDDGNTH | 1420 |
| vlCDR2 | SLS | 1421 |
| vlCDR3 | MQRKEFPLT | 1422 |
| Full length light chain | DIVMTQTPLSLPVTPGEPASMSCRSSRSLLDSDDGNTHLDWYLQKPGQSPQLLIQSLSYRASGVPDRFSGSGSGTDFTL EISRVEAEDVGIYYCMQRKEFPLTFGGGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 1423 |

Figure 63AA

CPA.7.050

| What | sequence | SEQ ID NO: |
|---|---|---|
| Variable heavy (vh) domain | EVQLVQSGAEVKKPGSSVKVSCKASGGTFSSYAISWVRQAPGQGLEWMGGIIPIFGTANYAQKFQGRVTITADKSTST AYMELSSLRSEDTAVYYCARGPWYYDSSGYSSYAYYMDVWGQGTTVTVSS | 1424 |
| vhCDR1 | GGTFSSYA | 1425 |
| vhCDR2 | IIPIFGTA | 1426 |
| vhCDR3 | ARGPWYYDSSGYSSYAYYMDV | 1427 |
| Full length HC | EVQLVQSGAEVKKPGSSVKVSCKASGGTFSSYAISWVRQAPGQGLEWMGGIIPIFGTANYAQKFQGRVTITADKSTST AYMELSSLRSEDTAVYYCARGPWYYDSSGYSSYAYYMDVWGQGTTVTVSSASTKGPSVFPLAPSSKSTSGGTAALGCL VKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1428 |
| Variable light (vl) domain | DVVMTQSPLSLPVTPGEPASISCRSSQSLLHSDGYNYLDWYLQKPGQSPQLLIYLGSNRASGVPDRFSGSGSGTDFTLKI SRVEAEDVGVYYCMQALHTPGVTFGGGTKVEIKR | 1429 |
| vlCDR1 | QSLLHSDGYNY | 1430 |
| vlCDR2 | LGS | 1431 |
| vlCDR3 | MQALHTPGVT | 1432 |
| Full length light chain | DVVMTQSPLSLPVTPGEPASISCRSSQSLLHSDGYNYLDWYLQKPGQSPQLLIYLGSNRASGVPDRFSGSGSGTDFTLKI SRVEAEDVGVYYCMQALHTPGVTFGGGTKVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 1433 |

Figure 63BB
CPA.7.028

| What | sequence | SEQ ID NO: |
|---|---|---|
| Variable heavy (vh) domain | QLQLQESGPGLVKPSETLSLTCTVTGGSISSSSYYWAWIRQPPGKGLEWIGGIYYSGSTYYNVSLESRVTISQDTSKNQFS LKLTSVTAADTAVYYCARGAWELRLGDWFDPWGQGTLVTVSS | 1434 |
| vhCDR1 | GGSISSSSYY | 1435 |
| vhCDR2 | IYYSGST | 1436 |
| vhCDR3 | ARGAWELRLGDWFDP | 1437 |
| Full length HC | QLQLQESGPGLVKPSETLSLTCTVTGGSISSSSYYWAWIRQPPGKGLEWIGGIYYSGSTYYNVSLESRVTISQDTSKNQFS LKLTSVTAADTAVYYCARGAWELRLGDWFDPWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKPSNTKVDKKVEPKSCDKTHTCPPCPAP ELLGGPSVFLFPPKPKDTLMISRTPEVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSREEMTKNQVSLTCLVKGFYPSDIAVEWESNGQPE NNYKTTPPVLDSDGSFFLYSKLTVDKSRWQQGNVFSCSVMHEALHNHYTQKSLSLSPGK | 1438 |
| Variable light (vl) domain | QSVLTQPPSVSGAPGQRVTISCTGSSNIGAGYDIQWYQQLPGTAPKLLIYGYSNRPSGVPDRFSGSKSGTSASLAITGL QAEDEADYYCQSYDSSLSVYVVFGGGTQLTVLGQPKAA | 1439 |
| vlCDR1 | SSNIGAGYD | 1440 |
| vlCDR2 | GYS | 1441 |
| vlCDR3 | QSYDSSLSVYVV | 1442 |
| Full length light chain | QSVLTQPPSVSGAPGQRVTISCTGSSNIGAGYDIQWYQQLPGTAPKLLIYGYSNRPSGVPDRFSGSKSGTSASLAITGL QAEDEADYYCQSYDSSLSVYVVFGGGTQLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS | 1443 |

Figure 63CC
CPA.7.030

| What | sequence | SEQ ID NO: |
|---|---|---|
| Variable heavy (vh) domain | QVQLQESGGGVVQPGGSLRLSCAASRFTFEDYAMHWVRQPPGKGLEWVSGISWKSGGINYADSVKGRFTISRDNAQ NSLYLQMNSLRAEDTALYYCVKDPTLVATDRAFNIWGQGTMVTVSS | 1444 |
| vhCDR1 | RFTFEDYA | 1445 |
| vhCDR2 | ISWKSGGI | 1446 |
| vhCDR3 | VKDPTLVATDRAFNI | 1447 |
| Full length HC | QVQLQESGGGVVQPGGSLRLSCAASRFTFEDYAMHWVRQPPGKGLEWVSGISWKSGGINYADSVKGRFTISRDNAQ NSLYLQMNSLRAEDTALYYCVKDPTLVATDRAFNIWGQGTMVTVSSASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTHTCPPC PAPELLGGPSVFLFPPKPKDTLMISRTPEVTCVVVDVSHEDPEVKFNWYVDGVEVHNAKTKPREEQYNSTYRVVSVLTV LHQDWLNGKEYKCKVSNKALPAPIEKTISKAKGQPREPQVYTLPPSREEMTKNQVSLTCLVKGFYPSDIAVEWESNGQ PENNYKTTPPVLDSDGSFFLYSKLTVDKSRWQQGNVFSCSVMHEALHNHYTQKSLSLSPGK | 1448 |
| Variable light (vl) domain | DVVMTQSPLSLPVTPGEPASISCRSSQSLLHSNGYNYLDWYLQKPGQSPQLLIYLGSNRASGVPDRFSGSGSGTDFTLKI SRVEAEDVGVYYCMQYLQTPDTFGQGTKLEIKRAAPS | 1449 |
| vlCDR1 | QSLLHSNGYNY | 1450 |
| vlCDR2 | LGS | 1451 |
| vlCDR3 | MQYLQTPDT | 1452 |
| Full length light chain | DVVMTQSPLSLPVTPGEPASISCRSSQSLLHSNGYNYLDWYLQKPGQSPQLLIYLGSNRASGVPDRFSGSGSGTDFTLKI SRVEAEDVGVYYCMQYLQTPDTFGQGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1453 |

Figure 63DD
CPA.7.041

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 1454 |
| vhCDR1 | GGTFSSSA | 1455 |
| vhCDR2 | IIPIYGIT | 1456 |
| vhCDR3 | ARDDTARRVRGVPYYYYAMDV | 1457 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1458 |
| Variable light (vl) domain | EIVLTQSPDFQSVTPKEKVTITCRASQNIDSSLHWYQQKPGQSPKLLINYASQSFSGVPSRFSGSGSGTDFTLTIDSLEPE DAATYFCHQSSSLPLTFGGGTKVEIRRTVAAPS | 1459 |
| vlCDR1 | QNIDSS | 1460 |
| vlCDR2 | YAS | 1461 |
| vlCDR3 | HQSSSLPLT | 1462 |
| Full length light chain | QSVLTQPPSVSGAPGQRVTISCTGSSSNIGAGYDIQWYQQLPGTAPKLLIYGYSNRPSGVPDRFSGSKSGTSASLAITGL QAEDEADYYCQSYDSSLSVYVFGGGTQLTVLGQPKAAPSVTLFPPSSEELQANKATLVCLISDFYPGAVTVAWKADSS PVKAGVETTTPSKQSNNKYAASSYLSLTPEQWKSHRSYSCQVTHEGSTVEKTVAPTECS | 1463 |

Figure 63EE CPA.7.016

| What | sequence | SEQ ID NO: |
|---|---|---|
| Variable heavy (vh) domain | EVQLVQSGAEVKKPGSSVKVSCKTSGGTFSSSAISWVRQAPGQGFEWMGGIIPIYGITDYAQKFQGRVTITTDESTSTAYMELSSLTSEDTAVYYCARDDTARRVRGVPYYYYAMDVWGQGTTVTVSS | 1464 |
| vhCDR1 | GGTFSSSA | 1465 |
| vhCDR2 | IIPIYGIT | 1466 |
| vhCDR3 | ARDDTARRVRGVPYYYYAMDV | 1467 |
| Full length HC | EVQLVQSGAEVKKPGSSVKVSCKTSGGTFSSSAISWVRQAPGQGFEWMGGIIPIYGITDYAQKFQGRVTITTDESTSTAYMELSSLTSEDTAVYYCARDDTARRVRGVPYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 1468 |
| Variable light (vl) domain | EIVLTQSPGTLSLSPGERATLSCRASQSVSSYLAWYQQKPGQAPRLLIYDASNRATGIPARFSGSGSGTDFTLTISSLQSEDFAVYYCQQYDDWPQTFGQGTRLEIKRTVAAPS | 1469 |
| vlCDR1 | QSVSSY | 1470 |
| vlCDR2 | DAS | 1471 |
| vlCDR3 | QQYDDWPQT | 1472 |
| Full length light chain | EIVLTQSPGTLSLSPGERATLSCRASQSVSSYLAWYQQKPGQAPRLLIYDASNRATGIPARFSGSGSGTDFTLTISSLQSEDFAVYYCQQYDDWPQTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 1473 |

Figure 63FF
CPA.7.020

| What | sequence | SEQ ID NO: |
|---|---|---|
| Variable heavy (vh) domain | QMQLVQSGAEVKKPGSSVKVSCKASGGTFSSSAISWVRQAPGQGFEWMGGIIPIYGITDYAQKFQGRVTITTDES TSTAYMELSSLTSEDTAVYYCARDDTARRVRGVPYYYYAMDVWGQGTTVTVSS | 1474 |
| vhCDR1 | GGTFSSSA | 1475 |
| vhCDR2 | IIPIYGIT | 1476 |
| vhCDR3 | ARDDTARRVRGVPYYYYAMDV | 1477 |
| Full length HC | QMQLVQSGAEVKKPGSSVKVSCKASGGTFSSSAISWVRQAPGQGFEWMGGIIPIYGITDYAQKFQGRVTITTDES TSTAYMELSSLTSEDTAVYYCARDDTARRVRGVPYYYYAMDVWGQGTTVTVSSASTKGPSVFPLAPSSKSTSGG TAALGCLVKDYFPEPVTVSWNSGALTSGVHTFPAVLQSSGLYSLSSVVTVPSSSLGTQTYICNVNHKPSNTKVDKKV EPKSCDKTHTCPPCPAPELLGGPSVFLFPPKPKDTLMISRTPEVTCVVVDVSHEDPEVKFNWYVDGVEVHNAKTKP REEQYNSTYRVVSVLTVLHQDWLNGKEYKCKVSNKALPAPIEKTISKAKGQPREPQVYTLPPSREEMTKNQVSLTC LVKGFYPSDIAVEWESNGQPENNYKTTPPVLDSDGSFFLYSKLTVDKSRWQQGNVFSCSVMHEALHNHYTQKSL SLSPGK | 1478 |
| Variable light (vl) domain | EIVMTQSPATLSLSTGERATLFCRTSQNVVGEVAWYQQKPGQAPRLLIYDTFERAAGIPAKFSGSGSGTDFTLTISR VEPEDFAVYYCQQRRDWPITFGQGTRLEIKRTVAAPS | 1479 |
| vlCDR1 | QNVYGE | 1480 |
| vlCDR2 | DTF | 1481 |
| vlCDR3 | QQRRDWPIT | 1482 |
| Full length light chain | EIVMTQSPATLSLSTGERATLFCRTSQNVVGEVAWYQQKPGQAPRLLIYDTFERAAGIPAKFSGSGSGTDFTLTISR VEPEDFAVYYCQQRRDWPITFGQGTRLEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLSSPVTKSFNRGEC | 1483 |

Figure 63GG
CPA.7.038

| What | sequence | SEQ ID NO: |
|---|---|---|
| Variable heavy (vh) domain | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 1484 |
| vhCDR1 | GGTFSSSA | 1485 |
| vhCDR2 | IIPIYGIT | 1486 |
| vhCDR3 | ARDDTARRVRGVPYYYYAMDV | 1487 |
| Full length HC | QVQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1488 |
| Variable light (vl) domain | DIQMTQSPSSLSASVGDRVTITCQASRDISDSLSWYQQKPGKAPKLLIFDASNLKTGVSSRFSGSGSGTDFTFTISSLQPE DIATYCHQYDNLPLTFGGGTKVEIKRTVAAPS | 1489 |
| vlCDR1 | RDISDS | 1490 |
| vlCDR2 | DAS | 1491 |
| vlCDR3 | HQYDNLPLT | 1492 |
| Full length light chain | DIQMTQSPSSLSASVGDRVTITCQASRDISDSLSWYQQKPGKAPKLLIFDASNLKTGVSSRFSGSGSGTDFTFTISSLQPE DIATYYCHQYDNLPLTFGGGTKVEIKRTVAAPSVFIFPPSDEQLKSGTASVVCLLNNFYPREAKVQWKVDNALQSGNSQ ESVTEQDSKDSTYSLSSTLTLSKADYEKHKVYACEVTHQGLSSPVTKSFNRGEC | 1493 |

Figure 63HH
CPA.7.044

| What | sequence | SEQ ID NO: |
|---|---|---|
| Variable heavy (vh) domain | QMQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSS | 1494 |
| vhCDR1 | GGTFSSSA | 1495 |
| vhCDR2 | IIPIYGIT | 1496 |
| vhCDR3 | ARDDTARRVRGVPYYYYAMDV | 1497 |
| Full length HC | QMQLVQSGAEVKKPGSSVKVSCKASGGTFSSSAISWVRQAPGQGFEWMGGIIPIYGITDYAQKFQGRVTITTDESTST AYMELSSLTSEDTAVYYCARDDTARRVRGVPYYYYAMDVWGQGTTVTVSSASTKGPSVFPLAPSSKSTSGGTAALGC LVKDYFPEPVTVSWNSGALTSGVHTFPAVLQSSGLYSLSSVVTVPSSSLGTQTYICNVNHKPSNTKVDKKVEPKSCDKTH TCPPCPAPELLGGPSVFLFPPKPKDTLMISRTPEVTCVVVDVSHEDPEVKFNWYVDGVEVHNAKTKPREEQYNSTYRV VSVLTVLHQDWLNGKEYKCKVSNKALPAPIEKTISKAKGQPREPQVYTLPPSREEMTKNQVSLTCLVKGFYPSDIAVEW ESNGQPENNYKTTPPVLDSDGSFFLYSKLTVDKSRWQQGNVFSCSVMHEALHNHYTQKSLSLSPGK | 1498 |
| Variable light (vl) domain | EIVMTQSPATLSLSPGERATLSCRASESVTTFLAWYQQKPGQAPRLLITDASNRATGIPGRFSGSGSGTDFTLTISSLEPE DFAVYYCHQHTNWPLTFGGGTKLEIKRTVAAPS | 1499 |
| vlCDR1 | ESVTTF | 1500 |
| vlCDR2 | DAS | 1501 |
| vlCDR3 | HQHTNWPLT | 1502 |
| Full length light chain | EIVMTQSPATLSLSPGERATLSCRASESVTTFLAWYQQKPGQAPRLLITDASNRATGIPGRFSGSGSGTDFTLTISSLEPE DFAVYYCHQHTNWPLTFGGGTKLEIKRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRGEC | 1503 |

Figure 63ll
CPA.7.045

| What | sequence | SEQ ID NO: |
|---|---|---|
| Variable heavy (vh) domain | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVGYCSGGSCYISYYYGMDVWGQGTTVTVSS | 1504 |
| vhCDR1 | GYTLTELS | 1505 |
| vhCDR2 | FDPEDGET | 1506 |
| vhCDR3 | ATEVGYCSGGSCYISYYYGMDV | 1507 |
| Full length HC | EVQLVQSGAEVKKPGASVKVSCKVSGYTLTELSMHWVRQAPGKGLEWMGGFDPEDGETIYAQKFQGRVTMTEDTS TDTAYMELSSLRSEDTAVYYCATEVGYCSGGSCYISYYYGMDVWGQGTTVTVSSASTKGPSVFPLAPSSKSTSGGTAAL GCLVKDYFPEPVTVSWNSGALTSGVHTFPAVLQSSGLYSLSSVVTVPSSSLGTQTYICNVNHKPSNTKVDKKVEPKSCDK THTCPPCPAPELLGGPSVFLFPPKPKDTLMISRTPEVTCVVVDVSHEDPEVKFNWYVDGVEVHNAKTKPREEQYNSTYR VVSVLTVLHQDWLNGKEYKCKVSNKALPAPIEKTISKAKGQPREPQVYTLPPSREEMTKNQVSLTCLVKGFYPSDIAVE WESNGQPENNYKTTPPVLDSDGSFFLYSKLTVDKSRWQQGNVFSCSVMHEALHNHYTQKSLSLSPGK | 1508 |
| Variable light (vl) domain | DVVMTQSPLSLPVTPGEPASISCRSSQSLLYRNGHNFLDWYVQKPGQSPQLLIYLGSNRASGVPDRFSGSGSGTDFTLKI SRVEAEDVGVYYCMQALQTPPTFGQGTKLEIKRTVAAPS | 1509 |
| vlCDR1 | QSLLYRNGHNF | 1510 |
| vlCDR2 | LGS | 1511 |
| vlCDR3 | MQALQTPPT | 1512 |
| Full length light chain | DVVMTQSPLSLPVTPGEPASISCRSSQSLLYRNGHNFLDWYVQKPGQSPQLLIYLGSNRASGVPDRFSGSGSGTDFTLKI SRVEAEDVGVYYCMQALQTPPTFGQGTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVTKSFNRGEC | 1513 |

Figure 63JJ

CHA.7.502

| What | sequence | SEQ ID NO: |
|---|---|---|
| Variable heavy (vh) domain | DVQLVESGGDLVQPGGSRKLSCTASGFTFSNFGMHWVRQAPEKGLEWVAYISSGSSTIYYADTVKGRFTISRDNPENTLFLQMTSLRSEDTAMYYCTRLDYYTNSYSMDHWGQGTSVTVSS | 1514 |
| vhCDR1 | GFTFSNFG | 1515 |
| vhCDR2 | ISSGSSTI | 1516 |
| vhCDR3 | TRLDYYTNSYSMDH | 1517 |
| Variable light (vl) domain | QIVLTQSPALMSASPGEKVTLTCSASSSLPYIYWYQQKPGSSPKPWIYLTSNLASGVPARFSGSRSGTSYSLTISSVEAEDAATYYCQQWSSNPFTFGSGTKLEIK | 1518 |
| vlCDR1 | SSLPY | 1519 |
| vlCDR2 | LTS | 1520 |
| vlCDR3 | QQWSSNPFT | 1521 |

Figure 63KK

CHA.7.503

| What | sequence | SEQ ID NO: |
|---|---|---|
| Variable heavy (vh) domain | QVQLQQSGAELAKPGASVKMSCKASGYTFTSNWMHWVKQRPGQGLEWIGYINPSNGYTECNQKFRDKATLSADKSSSTAYMQLNSLTSADSAVYYCALMISAWLPYWGQGTLVTVSA | 1522 |
| vhCDR1 | GYTFTSNW | 1523 |
| vhCDR2 | INPSNGYT | 1524 |
| vhCDR3 | ALMISAWLPY | 1525 |
| Variable light (vl) domain | DIVLTQSPASLAISLGQRATISCRASQSVSASSYSYVHWYQQKPGQPPKLLIKYASLESGVPARFSGSGSGTDFTLNIHPVEEEDTATYYCLHTWEIPYTFGGGTKLEIK | 1526 |
| vlCDR1 | QSVSASSYSY | 1527 |
| vlCDR2 | YAS | 1528 |
| vlCDR3 | LHTWEIPYT | 1529 |

Figure 63LL

CHA.7.506

| What | sequence | SEQ ID NO: |
|---|---|---|
| Variable heavy (vh) domain | QVQLQQSGAELTRPGASVNLSCKAS<u>GYTFTSYW</u>MQWVKQRPGQGLEWIGA<u>IYPG DGDT</u>RFNQKFKGKATLTADESSSTAYMQLSSLASEDSAVYYC<u>ATYYRYDDY</u>WGQGT TLTVSS | 1530 |
| vhCDR1 | GYTFTSYW | 1531 |
| vhCDR2 | IYPGDGDT | 1532 |
| vhCDR3 | ATYYRYDDY | 1533 |
| Variable light (vl) domain | QIVLTQSPAIMSASPGEKVTMTCSAS<u>SSVSY</u>MHWYQQKSGTSPKRWIY<u>DTS</u>KLASG VPTRFSGSGSGTSYSLTISSMEAEDAATYYC<u>QQWSSNPYT</u>FGGGTKLEIK | 1534 |
| vlCDR1 | SSVSY | 1535 |
| vlCDR2 | DTS | 1536 |
| vlCDR3 | QQWSSNPYT | 1537 |

Figure 63MM

CHA.7.508

| What | sequence | SEQ ID NO: |
|---|---|---|
| Variable heavy (vh) domain | EVQLQQSGPDLVKPGASMKISCKASGYTFIDYNIHWVKQSQGKSLDWIGYIYPYNGGTGYNQKFKNKATLTVDSSSSTAYMEVRSLTFEDSAVYFCAREADYYGNRGQFDYWGQGTLVTVSA | 1538 |
| vhCDR1 | GYTFIDYN | 1539 |
| vhCDR2 | IYPYNGGT | 1540 |
| vhCDR3 | AREADYYGNRGQFDY | 1541 |
| Variable light (vl) domain | DIQMTQSPASLSVSVGETVTITCRASENIFSNLAWYQQKQGKSPQLLVYGEANLADGVPSRFSGSGSGTQYSLKINSLQSEDFGNYYCQHFWGTPYTFGGGTTLEIK | 1542 |
| vlCDR1 | ENIFSN | 1543 |
| vlCDR2 | GEA | 1544 |
| vlCDR3 | QHFWGTPYT | 1545 |

Figure 63NN

CHA.7.510

| What | sequence | SEQ ID NO: |
|---|---|---|
| Variable heavy (vh) domain | QVTLKESGPGILQPSQTLSLTCSFSGFSLNTSGTGVGWIRQPSGKGLEWLTHIWWNDNKFYNTFLKSRLTISKETSNNQVFLKIASVDTADAATYYCARMAYGNLWFVNWGQGTLVAVST | 1546 |
| vhCDR1 | GFSLNTSGTG | 1547 |
| vhCDR2 | IWWNDNK | 1548 |
| vhCDR3 | ARMAYGNLWFVN | 1549 |
| Variable light (vl) domain | DIVLTQSPASLAVSLGQRASISCRASRSVTISGYSYMYWYQQKPGQPPRLLFYLASNLASGVPARFSGSGSGTDFTLNIHPVEEEDAAIYYCQHSRELPYTFGGGTKLEIK | 1550 |
| vlCDR1 | RSVTISGYSY | 1551 |
| vlCDR2 | LAS | 1552 |
| vlCDR3 | QHSRELPYT | 1553 |

Figure 63OO

CHA.7.512

| What | sequence | SEQ ID NO: |
|---|---|---|
| Variable heavy (vh) domain | QIQLVQSGPELKKPRETVKISCKAS<u>GYTFTDYS</u>MHWVKQAPGKGLKWMGW<u>INTET GEP</u>TYADDFKGRFAFSLEASASSAYLQINILKDEDTATYFC<u>ARSRGGYYEDYYALDY</u>W GQGTSVTVSS | 1554 |
| vhCDR1 | GYTFTDYS | 1555 |
| vhCDR2 | INTETGEP | 1556 |
| vhCDR3 | ARSRGGYYEDYYALDY | 1557 |
| Variable light (vl) domain | DIQMTQSPASLSASVGESVTITCRAS<u>GNIHYY</u>LAWYQQKQGKSPQLLVY<u>NAK</u>NLAD GVPSRFSGSGSGTQFSLKINSLQPEDFGSYYC<u>QHFWISPPT</u>FGGGTKLEIK | 1558 |
| vlCDR1 | GNIHYY | 1559 |
| vlCDR2 | NAK | 1560 |
| vlCDR3 | QHFWISPPT | 1561 |

Figure 63PP

CHA.7.514

| What | sequence | SEQ ID NO: |
|---|---|---|
| Variable heavy (vh) domain | EVQLRQSGADLVKPGASVKLSCTASGFNIKDTYIDWVKQRPEQGLDWIGRIDPANGNTKYDPKFQGKATIITDTSSNTAYLQLSNLTSEDTAVYYCARYGSYPYFDYWGRGTTLAVSS | 1562 |
| vhCDR1 | GFNIKDTY | 1563 |
| vhCDR2 | IDPANGNT | 1564 |
| vhCDR3 | ARYGSYPYFDY | 1565 |
| Variable light (vl) domain | SIVMTQTPKFLLISAGDRVTITCKASQSVRNDVAWYQQKPGQSPKLLMYYASNRYTGVPDRFTGSGYGTDFTFTISTVQAEDLAVYFCQQDYSSPPTFGGGTKLEIK | 1566 |
| vlCDR1 | QSVRND | 1567 |
| vlCDR2 | YAS | 1568 |
| vlCDR3 | QQDYSSPPT | 1569 |

Figure 63QQ

CHA.7.516

| What | sequence | SEQ ID NO: |
|---|---|---|
| Variable heavy (vh) domain | QVQLQQSGPELVRPGVSVKISCKVSGYTFTDYVMHWVKQSHAKSLEWIGIISPYSGNTNYNQNFKGKATMTVDKSSSTAYMALARLTSEDSAIYYCAREGDLPMFAYWGQGTLVTVSA | 1570 |
| vhCDR1 | GYTFTDYV | 1571 |
| vhCDR2 | ISPYSGNT | 1572 |
| vhCDR3 | AREGDLPMFAY | 1573 |
| Variable light (vl) domain | QIVLTQSPTIMSASPGEKVTMTCSASSSVSYIYWYQQNPGSSPRLLIYDTSILASGVPFRFSGSGSGTSYSLTISRMEAEDAATYYCQQWTSYPLTFGSGTKLELK | 1574 |
| vlCDR1 | SSVSY | 1575 |
| vlCDR2 | DTS | 1576 |
| vlCDR3 | QQWTSYPLT | 1577 |

Figure 63RR

CHA.7.518

| What | sequence | SEQ ID NO: |
|---|---|---|
| Variable heavy (vh) domain | EVQLQQSGPELVKPGASVKISCKASGYTFTDYNINWVKQSHGKSLEWIGYIYPYIGGS GYNQKFKSKATLSADNPSSTAYMELRSLTSEDSAVYYCAREDKTARNAMDYWGQG TPVTVSS | 1578 |
| vhCDR1 | GYTFTDYN | 1579 |
| vhCDR2 | IYPYIGGS | 1580 |
| vhCDR3 | AREDKTARNAMDY | 1581 |
| Variable light (vl) domain | DIQMTQSPASLSVSVGETVTIICRVSENIYSNLAWYQQKQGKSPQLLVYEATNLAEG VPSRFSGSGSGTQYSLKINSLQSEDFGSYYCQHFWGTPYTFGGGTKLEIK | 1582 |
| vlCDR1 | ENIYSN | 1583 |
| vlCDR2 | EAT | 1584 |
| vlCDR3 | QHFWGTPYT | 1585 |

Figure 63SS

CHA.7.520_1

| What | sequence | SEQ ID NO: |
|---|---|---|
| Variable heavy (vh) domain | DVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARHYRYPPYAMDYWGQGTSVTVSS | 1586 |
| vhCDR1 | GYSITSDYA | 1587 |
| vhCDR2 | ISYSGST | 1588 |
| vhCDR3 | ARHYRYPPYAMDY | 1589 |
| Variable light (vl) domain | DIVMTQSPSSLAMSVGQKVTMSCKSSQSLLNSSNQKNYLAWYQQKPGQSPKLLVYFASTRESGVPDRFIGSGSGTDFTLTITSVQAEDLADYFCQQHYSTPFTFGSGTKLEIK | 1590 |
| vlCDR1 | QSLLNSSNQKNY | 1591 |
| vlCDR2 | FAS | 1592 |
| vlCDR3 | QQHYSTPFT | 1593 |

Figure 63TT

CHA.7.520_2

| What | sequence | SEQ ID NO: |
|---|---|---|
| Variable heavy (vh) domain | QVQLKQSGPGLVQPSQSLSITCTVSGFSLTSFGVHWVRQSPGKGLEWLGVIWSGGTTVYDAAFISRLSISKDNSKSQVFFKMNSLQTNDTAIYYCARKRGNFYVMDYWGQGTSVTVSS | 1594 |
| vhCDR1 | GFSLTSFG | 1595 |
| vhCDR2 | IWSGGTT | 1596 |
| vhCDR3 | ARKRGNFYVMDY | 1597 |
| Variable light (vl) domain | DIVMTQSPSSLAMSVGQKVTMSCKSSQSLLNSSNQKNYLAWYQQKPGQSPKLLVYFASTRESGVPDRFIGSGSGTDFTLTITSVQAEDLADYFCQQHYSTPFTFGSGTKLEIK | 1598 |
| vlCDR1 | QSLLNSSNQKNY | 1599 |
| vlCDR2 | FAS | 1600 |
| vlCDR3 | QQHYSTPFT | 1601 |

Figure 63UU

CHA.7.522

| What | sequence | SEQ ID NO: |
|---|---|---|
| Variable heavy (vh) domain | QVQLQQPGSELVRPGTSVKLSCKASGYTFTSYWVHWVRQRHGQGLEWIGNVYPGSGSTNYDEKFKSKGTLTVDTSSSTAYMHLSSLTSEDSAVYYCTRGVLRFPLDYWGQGTTLTVSS | 1602 |
| vhCDR1 | GYTFTSYW | 1603 |
| vhCDR2 | VYPGSGST | 1604 |
| vhCDR3 | TRGVLRFPLDY | 1605 |
| Variable light (vl) domain | DIVMTQAAPSVPVTPGESVSISCRSSKSLLHSNGNTYLYWFLQRPGQSPHLLIYRMSNLASGVPDRFSGSGSGTAFTLRISRVEAEDVGVYYCMQHLEYPLTFGAGTKLELK | 1606 |
| vlCDR1 | KSLLHSNGNTY | 1607 |
| vlCDR2 | RMS | 1608 |
| vlCDR3 | MQHLEYPLT | 1609 |

Figure 63VV

CHA.7.524

| What | sequence | SEQ ID NO: |
|---|---|---|
| Variable heavy (vh) domain | QVQLQQSGPEVVRPGVSVKISCKGSGYKFPDYVMHWVKQSHAKSLEWIGIISIYSGNTNYNQKFKGKATMTVDKSSSTAYMELARLTSEDSAIYYCAREGDLPMFAYWGQGTLVTVSA | 1610 |
| vhCDR1 | GYKFPDYV | 1611 |
| vhCDR2 | ISIYSGNT | 1612 |
| vhCDR3 | AREGDLPMFAY | 1613 |
| Variable light (vl) domain | QIVLTQSPAIMSASPGEKVTMTCNASSSVSYMYWYQQKPISSPRLLIYDTSNLASGVPVRFSGSGSGTSYSLTIGRMEAEDAATYYCQQWSSYPLTFGAGTKVEVK | 1614 |
| vlCDR1 | SSVSY | 1615 |
| vlCDR2 | DTS | 1616 |
| vlCDR3 | QQWSSYPLT | 1617 |

Figure 63WW

CHA.7.526

| What | sequence | SEQ ID NO: |
|---|---|---|
| Variable heavy (vh) domain | QVQLKESGPGLVAPSQSLSITCTVSGFSLTAYNINWVRQPPGKGLEWLGMIWGDGNTDYNSPLKSRLTISKDNSKSQVFLKMDSLQTDDTARYYCARDLKVRRDSPYTMDYWGQGTSVTVSS | 1618 |
| vhCDR1 | GFSLTAYN | 1619 |
| vhCDR2 | IWGDGNT | 1620 |
| vhCDR3 | ARDLKVRRDSPYTMDY | 1621 |
| Variable light (vl) domain | NIMMTQSPSSLAVSAGEKVTMSCKSSQSVLYSSNQKNYLAWYQQKPGQSPKLLIYWASNRESGVPDRFTGSGSGTDFTLTISSVQAEDLAVYYCHQYLSSYTFGGGTKLEIK | 1622 |
| vlCDR1 | QSVLYSSNQKNY | 1623 |
| vlCDR2 | WAS | 1624 |
| vlCDR3 | HQYLSSYT | 1625 |

Figure 63XX

CHA.7.527

| What | sequence | SEQ ID NO: |
|---|---|---|
| Variable heavy (vh) domain | DVQLQESGPGLVKPSQSLSLTCTVTGYSLTSDYAWNWIRQFPGNKLEWMGYITYSGGTTYNPSLKSRISITRDTSKNQFFLQLTSVTTEDTATYYCARRGSGTTVVGDWYFDVWGAGTTVTVSS | 1626 |
| vhCDR1 | GYSLTSDYA | 1627 |
| vhCDR2 | ITYSGGT | 1628 |
| vhCDR3 | ARRGSGTTVVGDWYFDV | 1629 |
| Variable light (vl) domain | DIVMSQSPSSLAVSVGEKVTMSCKSSQSLLYSFNQKYYLAWYQQKPGQSPKLLIYWASTRESGVPDRFTGSGSGTDFTPTISSVTAEDLAVYYCQQFYTYPYTFGGGTKLEMK | 1630 |
| vlCDR1 | QSLLYSFNQKYY | 1631 |
| vlCDR2 | WAS | 1632 |
| vlCDR3 | QQFYTYPYT | 1633 |

Figure 63YY

CHA.7.528

| What | sequence | SEQ ID NO: |
|---|---|---|
| Variable heavy (vh) domain | EVQVQQSGPELVKPGASVKISCKASGYTFTKSNMHWVKQSHGKSLEWIGYIYPYNGGTGYNQNFKSKATLTVDISSSTAYMELRSLTLEDSAVYLCAREADYYGNRGQFDYWGQGTLVTVSA | 1634 |
| vhCDR1 | GYTFTKSN | 1635 |
| vhCDR2 | IYPYNGGT | 1636 |
| vhCDR3 | AREADYYGNRGQFDY | 1637 |
| Variable light (vl) domain | DIQMTQSPASLSVSVGETVTITCRASDNIFSNLAWYHQKQGKSPHLLVYGATNLADGVPSRFSGSGSGTQYSLKINSLQSEDFGDYYCQHFWGTPYTFGGGTKLEIK | 1638 |
| vlCDR1 | DNIFSN | 1639 |
| vlCDR2 | GAT | 1640 |
| vlCDR3 | QHFWGTPYT | 1641 |

Figure 63ZZ

CHA.7.530

| What | sequence | SEQ ID NO: |
|---|---|---|
| Variable heavy (vh) domain | QVQLQQSGAELMRPGTSVKVSCKASGYAFTNHLIEWIKQRPGQGLEWIGVINPGSDSTDYNEKFKDKATLTADKSSSTAYMQLSSLTSDDSAVYFCARSLYYNSWFVYWGQGTLVTVSA | 1642 |
| vhCDR1 | GYAFTNHL | 1643 |
| vhCDR2 | INPGSDST | 1644 |
| vhCDR3 | ARSLYYNSWFVY | 1645 |
| Variable light (vl) domain | DIQMTQSPASLSASVGETVTITCRASENIYSYLAWYQQKRGKSPQLLVYNAKTLVEGVPSRFSGSGSGTQFSLKINSLQPEDFGSYYCQHHYGTPYTFGGGTKLEIK | 1646 |
| vlCDR1 | ENIYSY | 1647 |
| vlCDR2 | NAK | 1648 |
| vlCDR3 | QHHYGTPYT | 1649 |

Figure 63AAA

CHA.7.534

| What | sequence | SEQ ID NO: |
|---|---|---|
| Variable heavy (vh) domain | EVQLQQSGAELVKPGASVRLSCTASGFSIRDTYIHWVKQRPEQGLDWIGKIDPANGKSEYDPKFQGRATMTTDTSSNTAYLQLSSLTSEDTAVYYCTRYGYYPYFDVWGAGTTVTVFS | 1650 |
| vhCDR1 | GFSIRDTY | 1651 |
| vhCDR2 | IDPANGKS | 1652 |
| vhCDR3 | TRYGYYPYFDV | 1653 |
| Variable light (vl) domain | SIVMTQTPKFLLVSAGDRVAITCKASQSVRHDVVWYQQKPGQSPKLLIYYASSRYTGVPDRFTGSGYGTDFTFTISTVQAEDLALYFCLQDFSSPWTFGGGTKLEIK | 1654 |
| vlCDR1 | QSVRHD | 1655 |
| vlCDR2 | YAS | 1656 |
| vlCDR3 | LQDFSSPWT | 1657 |

Figure 63BBB

CHA.7.535

| What | sequence | SEQ ID NO: |
|---|---|---|
| Variable heavy (vh) domain | EVQLQQSGPELVKPGASVKISCKTSGYTFTKNTMHWVRQSHGKSLEWIGGINPNSGGASFNQKFMGKATLTVDKSSSTAYMELRSLTSEDSAVYYCARDGYDGDWFFDVWGAGTTVTVSS | 1658 |
| vhCDR1 | GYTFTKNT | 1659 |
| vhCDR2 | INPNSGGA | 1660 |
| vhCDR3 | ARDGYDGDWFFDV | 1661 |
| Variable light (vl) domain | DIQMNQSPFSLSASLGDTVTITCHASQNIYVWLSWYQQKPGNIPKLLIYKASDLHTGVPSRFSGSGSGTDFTLNISSLQPEDIATYYCQQGQSYPRTFGGGTKLEIK | 1662 |
| vlCDR1 | QNIYVW | 1663 |
| vlCDR2 | KAS | 1664 |
| vlCDR3 | QQGQSYPRT | 1665 |

Figure 63CCC

CHA.7.537

| What | sequence | SEQ ID NO: |
|---|---|---|
| Variable heavy (vh) domain | QVQLKESGPGLVAPSQSLSITCTVSGFSLIGHGVNWIRQPPGKGLEWLGVIWGDGNTDYNSALKSRLSISKDNSKSQVFLKMNSLQTDDTARYFCAVNSAMDYWGQGTAVTVSS | 1666 |
| vhCDR1 | GFSLIGHG | 1667 |
| vhCDR2 | IWGDGNT | 1668 |
| vhCDR3 | AVNSAMDY | 1669 |
| Variable light (vl) domain | NIVMTQSPKSMSMSVGERVTLNCTASENVASFVSWYQQKPEQSPKLLIYGTSNRYTGVPDRFTGSGSATDFTLTISSVQAEDLGDYHCGQSYNYPFTFGSGTKLEIE | 1670 |
| vlCDR1 | ENVASF | 1671 |
| vlCDR2 | GTS | 1672 |
| vlCDR3 | GQSYNYPFT | 1673 |

Figure 63DDD

CHA.7.538_1

| What | sequence | SEQ ID NO: |
|---|---|---|
| Variable heavy (vh) domain | QVQLQQSGAELVRPGASVKVSCKTSGYAFTNYLIEWVKQRPGQGLEWIGVINPGSGGIYYNDKFKVKTTLTADKSSSTAYMQLSSLTSDDSAVYFCARSETHDTWFAYWGQGTLVTVSA | 1674 |
| vhCDR1 | GYAFTNYL | 1675 |
| vhCDR2 | INPGSGGI | 1676 |
| vhCDR3 | ARSETHDTWFAY | 1677 |
| Variable light (vl) domain | DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIKR | 1678 |
| vlCDR1 | QSVRIA | 1679 |
| vlCDR2 | LAS | 1680 |
| vlCDR3 | LQHWNYPYT | 1681 |

Figure 63EEE

CHA.7.538_2

| What | sequence | SEQ ID NO: |
|---|---|---|
| Variable heavy (vh) domain | QVQLQQSGAELVRPGTSVKMSCKAAGYTFTNYWIGWVKQRPGHGLEWIGDIYPGGGYTNYNEKFKGKATLTADTSSSTAYMQLSSLTSEDSAIYYCASPYYGSSYGFAFWGQGTLVTVSA | 1682 |
| vhCDR1 | GYTFTNYW | 1683 |
| vhCDR2 | IYPGGGYT | 1684 |
| vhCDR3 | ASPYYGSSYGFAF | 1685 |
| Variable light (vl) domain | DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIKR | 1686 |
| vlCDR1 | QSVRIA | 1687 |
| vlCDR2 | LAS | 1688 |
| vlCDR3 | LQHWNYPYT | 1689 |

Figure 63FFF

CHA.7.543

| What | sequence | SEQ ID NO: |
|---|---|---|
| Variable heavy (vh) domain | QVQLKESGPGLVAPSQSLSITCTVSGFSLSGYGIKWVRQPPGKGLEWLGTIWGDGSTDYNSALKSRLSISKDNSKSQVFLKMTSLQTDDTARYYCASDSLGITFGYWGQGTLVTVSA | 1690 |
| vhCDR1 | GFSLSGYG | 1691 |
| vhCDR2 | IWGDGST | 1692 |
| vhCDR3 | ASDSLGITFGY | 1693 |
| Variable light (vl) domain | DIQMTQTTSSLSASLGDRVTISCRASQDISNYLNWYQQKPDGTVKLLIYYTSRLHSGVPSRFSGSGSGTDYSLTISNLEQEDIATYFCQQGNTLPLTFGAGTKLELK | 1694 |
| vlCDR1 | QDISNY | 1695 |
| vlCDR2 | YTS | 1696 |
| vlCDR3 | QQGNTLPLT | 1697 |

Figure 63GGG

CHA.7.544

| What | sequence | SEQ ID NO: |
|---|---|---|
| Variable heavy (vh) domain | QVQLKESGPGLVAPSQSLSITCTVSGFSLTSYAITWVRQPPGKGLEWLGVIWPGGGTNYNSALKSRLSISKDNSKSHLFLKMNSLQTDDTARYYCVRSYDGYLDWYFDVWGTGTTVTVSS | 1698 |
| vhCDR1 | GFSLTSYA | 1699 |
| vhCDR2 | IWPGGGT | 1700 |
| vhCDR3 | VRSYDGYLDWYFDV | 1701 |
| Variable light (vl) domain | NIVMTQSPKSMSMSVGERVTLSCKASENVGTYVSWYQQKPDQSPKLLIYGASNRYTGVPDRFTGSGSATDFTLIISSVQAEDLSDYHCGQSYSYPYTFGGGTKLEII | 1702 |
| vlCDR1 | ENVGTY | 1703 |
| vlCDR2 | GAS | 1704 |
| vlCDR3 | GQSYSYPYT | 1705 |

Figure 63HHH

CHA.7.545

| What | sequence | SEQ ID NO: |
|---|---|---|
| Variable heavy (vh) domain | QIQLVQSGPDLKKPGETVKISCKAS<u>GYTFTTYG</u>MSWVKQAPGRGLKWMGW<u>INTYSGVS</u>TFPDDFKGRFAFSLETSASTAYLQINNLKNEDSATYFC<u>ARLGMGSTTGAGYFDV</u>WGTGTTVTVSS | 1706 |
| vhCDR1 | GYTFTTYG | 1707 |
| vhCDR2 | INTYSGVS | 1708 |
| vhCDR3 | ARLGMGSTTGAGYFDV | 1709 |
| Variable light (vl) domain | DIVLTQSPAIMSASPGEKVTMTCSAS<u>SSVSSWY</u>LHWYQQKSGASPKLWIY<u>GTS</u>NLASGVPARFSGSGSGTSYSLTISSVEAEDAATYYC<u>QQYRSDPYT</u>FGSGTKLEIK | 1710 |
| vlCDR1 | SSVSSWY | 1711 |
| vlCDR2 | GTS | 1712 |
| vlCDR3 | QQYRSDPYT | 1713 |

Figure 63III

CHA.7.546

| What | sequence | SEQ ID NO: |
|---|---|---|
| Variable heavy (vh) domain | QIQLVQSGPELKKPGETVKISCKASGYTFTTYGMSWVKQAPGKGLKWMGWINTYSGVSTYADDFEGRFAFSLETSVSTAYLQINNLKNEDTATYFCARLGRGSTTGAGYLDVWGTGTTVTVSS | 1714 |
| vhCDR1 | GYTFTTYG | 1715 |
| vhCDR2 | INTYSGVS | 1716 |
| vhCDR3 | ARLGRGSTTGAGYLDV | 1717 |
| Variable light (vl) domain | DIVLTQSPAIMSASPGEKVSMTCSASSSVSSWYLHWYQQKSGASPKLWIYGTSNLASGVPARFSGSGSGTSYSLTISSVEAEDAATYYCQQYHSDPYTFGSGTKLEIK | 1718 |
| vlCDR1 | SSVSSWY | 1719 |
| vlCDR2 | GTS | 1720 |
| vlCDR3 | QQYHSDPYT | 1721 |

Figure 63JJJ

CHA.7.547

| What | sequence | SEQ ID NO: |
|---|---|---|
| Variable heavy (vh) domain | QIQLVQSGPDLKKPGETVKISCKASGYTFTTYGMSWVKQAPGRGLKWMGWINTYSGVSTFPDDFKGRFAFSLETSASTAYLQINNLKNEDSATYFCARLGMGSTTGAGYFDVWGTGTTVTVSS | 1722 |
| vhCDR1 | GYTFTTYG | 1723 |
| vhCDR2 | INTYSGVS | 1724 |
| vhCDR3 | ARLGMGSTTGAGYFDV | 1725 |
| Variable light (vl) domain | ENVLTQSPAIMSASLGEKVTLSCRASSSVNYMYWYQQKSDASPKLWIYYTSNLAPGVPARFSGSGSGNSYSLTISSVEGEDAATYYCQQFTSSPWTFGGGTKLEIK | 1726 |
| vlCDR1 | SSVNY | 1727 |
| vlCDR2 | YTS | 1728 |
| vlCDR3 | QQFTSSPWT | 1729 |

Figure 63KKK

CHA.7.548

| What | sequence | SEQ ID NO: |
|---|---|---|
| Variable heavy (vh) domain | EVQLQQSGPELVKPGASVKISCKAS<u>GYTFTDYS</u>MNWVKQSHGKSLEWIGD<u>ITPNNG SP</u>NYNQKFKDKATLTVDKSSSTVYMELRSLTSEDSAVYYC<u>ASLFFDY</u>WGHGTTLTVSS | 1730 |
| vhCDR1 | GYTFTDYS | 1731 |
| vhCDR2 | ITPNNGSP | 1732 |
| vhCDR3 | ASLFFDY | 1733 |
| Variable light (vl) domain | DIVMTQSPSSLSVSAGEKVTMSCKSS<u>QSLLNSGNQKNY</u>LAWYQQKPGQPPKLLIY<u>G AS</u>TRDSGVPDRFTGSGSGTDFTLTITSVQAEDLAVYYC<u>QNDHTYPYT</u>FGGGTKLEIK | 1734 |
| vlCDR1 | QSLLNSGNQKNY | 1735 |
| vlCDR2 | GAS | 1736 |
| vlCDR3 | QNDHTYPYT | 1737 |

Figure 63LLL

CHA.7.549

| What | sequence | SEQ ID NO: |
|---|---|---|
| Variable heavy (vh) domain | QVQLQQPGTELVKPGASVKLSCKAS<u>GFTFTTHW</u>MHWVRQRPGQGLEWIGN<u>IYPSNGGS</u>NYNEKFKTKATLTVDRSSSTAYMHLSSLTSEDSAVYYC<u>ARRVNWDGYYFDY</u>WGQGTTLTVSS | 1738 |
| vhCDR1 | GFTFTTHW | 1739 |
| vhCDR2 | IYPSNGGS | 1740 |
| vhCDR3 | ARRVNWDGYYFDY | 1741 |
| Variable light (vl) domain | DIVMTQSQKFMSTSVGDRVSVTCKAS<u>QNVGTN</u>VAWYQQKPGQSPKLLIY<u>SAS</u>YRYSGVPDRFTGSGSGTDFTLTISNVQSEDLADYFC<u>QQYNSYPLT</u>FGGGTKLEIK | 1742 |
| vlCDR1 | QNVGTN | 1743 |
| vlCDR2 | SAS | 1744 |
| vlCDR3 | QQYNSYPLT | 1745 |

Figure 63MMM

CHA.7.550

| What | sequence | SEQ ID NO: |
|---|---|---|
| Variable heavy (vh) domain | QVQLQESGTELVKPGASVKLSCKASGYTFTSYWIHWVKQRPGQGLEWIGNINPSNGGTNYNEKFKSKAALTVDKSSSTAYMQLSSLTSEDSAVYYCARRGLPYFFDYWGQGTTLTVSS | 1746 |
| vhCDR1 | GYTFTSYW | 1747 |
| vhCDR2 | INPSNGGT | 1748 |
| vhCDR3 | ARRGLPYFFDY | 1749 |
| Variable light (vl) domain | DIVMTQSQKFMSTSVGDRVSVTCKGSQNVGYNVAWYQQKPGQSPKALVYSASDRHSGVPDRFAGSGSGTDFTLTISNVQSEDLAEYFCQQYNSYPLTFGAGTKLELK | 1750 |
| vlCDR1 | QNVGYN | 1751 |
| vlCDR2 | SAS | 1752 |
| vlCDR3 | QQYNSYPLT | 1753 |

Figure 63NNN
Humanized sequences of CHA.7.518 antibody VH

Potential humanized sequence based on IMGT IGHV1-46*01 acceptor framework (AbM CDR definition)

```
IGHV1-46*01  QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
(SEQ ID NO: 1754)

Joining region  IMGT J00256|IGHJ4*01|YFDYWGQGTLVTVSS (SEQ ID NO: 1755)

seq                   10         20         30         40         50         60         70         80  abc   90
AbM                   10         20         30         40         50 a       60         70         80 bbbb b  90 bibibb
           b b b   p  b b b b    b b    b b  b  b i i  i bb b           i  b  b b b x       ****  *** ****  **  *    *
518        EVQLQQSGPELVKPGASVKISCKAS GYTFTDYNIN WKQSHGKSLEWIG YIYPYIGGSG YNQKFKSKATLSADNPSSTAYMLRSLTSEDSAVYYCAR
           *                     *                  *                    *                                *
1-46*01    QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h518H1     QVQLVQSGAEVKKPGASVKVSCKAS GYTFTDYNIN WVRQAPGQGLEWMG YIYPYIGGSG YAQKFQGRVTMTRDTSTSTVYMELSSLRSEDTAVYYCAR
h518H2     QVQLVQSGAEVKKPGASVKVSCKAS GYTFTDYNIN WVRQAPGQGLEWIG YIYPYIGGSG YAQKFQGRVTMTADTSTSTVYMELSSLRSEDTAVYYCAR
h518H3     QVQLVQSGAEVKKPGASVKISCKAS GYTFTDYNIN WVRQAPGQGLEWIG YIYPYIGGSG YAQKFQGRATLTADTSTST&YMELSSLRSEDTAVYYCAR
h518H4     QVQLVQSGAEVKKPGASVKISCKAS GYTFTDYNIN WVRQAPGQGLEWIG YIYPYIGGSG YAQKFQGRATLTADWSTSTAYMELSSLRSEDTAVYYCAR
                               V                              #                                       N seq        100        110        120
AbM                   110
                    i  b b b
518        EDKTARNAMDY WGQGTPVTVSS  (SEQ ID NO: 1756)
                    *             ("1-46*01" sequence is disclosed as SEQ ID NO: 1757)
h518H1     EDKTARNAMDY WGQGTLVTVSS  (SEQ ID NO: 1758)
h518H2     EDKTARNAMDY WGQGTLVTVSS  (SEQ ID NO: 1759)
h518H3     EDKTARNAMDY WGQGTLVTVSS  (SEQ ID NO: 1760)
h518H4     EDKTARNAMDY WGQGTLVTVSS  (SEQ ID NO: 1761)
              #
```

\# deamidation substitutions: Q/S/A

Figure 63000
Humanized sequences of CHA.7.518 antibody VL

Potential humanized sequence based on IMGT IGKV1-39*01 acceptor framework

IGKV1-39*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 1762)

Joining region IMGT J00242|IGKJ2*01|YTFGQGTKLEIK (SEQ ID NO: 1763)

```
seq                 10         20         30         40         50         60         70         80
AbM                 10         20         30         40         50         60         70         80
         b b b  p p   p b b  b b  b  bi bi  i    ii ibbi  i          b b     b b b   b b b     ib bib
518      DIQMTQSPASLSVSVGETVTIIC RVSENIYSNLA WYQQKQGKSPQLLVY EATNLAE GVPSRFSGSGSGTQYSLKINSLQSEDFGSYYC
          *            *  *                *                  *              ***  *   *** *    *   *

IGKV1-39 DIQMTQSPSSLSASVGDRVTITC RASQSISSYIN WYQQKPGKAPKLLIY AASSLQS GVPSRFSGSGSGTDFTLTISSLQPEDFATYYC
h518L1   DIQMTQSPSSLSASVGDRVTITC RVSENIYSNLA WYQQKPGKAPKLLIY EATNLAE GVPSRFSGSGSGTDFTLTISSLQPEDFATYYC
h518L2   DIQMTQSPSSLSASVGDRVTITC RVSENIYSNLA WYQQKPGKAPKLLIY EATNLAE GVPSRFSGSGSGTDXTLTISSLQPEDFATYYC
h518L3   DIQMTQSPSSLSASVGDRVTITC RVSENIYSNLA WYQQKPGKAPKLLVY EATNLAE GVPSRFSGSGSGTDYTLTISSLQPEDFSTYYC
              V                          #                 S                     #                # seq         90        100
AbM         90        100
         ibi iib  i   b b b
518      QHFWGTPYT   QQSYSTPP (SEQ ID NO: 1765)
           *
IGKV1-39 QHFWGTPYT   FGQGTKLEIK (SEQ ID NO: 1764)
h518L1   QHFWGTPYT   FGQGTKLEIK (SEQ ID NO: 1766)
h518L2   QHFWGTPYT   FGQGTKLEIK (SEQ ID NO: 1767)
h518L3   QHFWGTPYT   FGQGTKLEIK (SEQ ID NO: 1768)
              @
```

\# deamidation substitutions: Q/S/A/D
@ tryptophan oxidation substitutions: Y/F/H

Figure 63PPP
Humanized sequences of CHA.7.538_1 antibody VH

Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 1769)
Joining region    IMGT J00256|IGHJ4*01|YFDYWGQGTLVTVSS (SEQ ID NO: 1770)

```
seq             10         20         30         40         50         60         70         80         90
AbM             10         20         30         40         50    a    60         70         80  abc    90
                b b b    p  b b b b    b b   b  b i i   i bb  b    i   bbb  x    bbb  b   bibibb
538_1    QVQLQQSGAELVRPGASVKVSCKTS GYAFTNYLIE WVKQRPGQGLEWIG VINPGSGGIY YNDKFKVKTTLTADKSSSTAYMQLSSLTSDDSAVYFCAR
         *                *  *  *     *   *      *          *          **          *   *  *   *  * *    *
1-46*01  QVQLVQSGAEVKKPGASVKVSCKAS  GYTFTSYYMH WVRQAPGQGLEWMG IINPSGGSTS YAQKFQGRVTMTRDTSTSTVYMELSSLRSEDTAVYYCAR
h5381H1  QVQLVQSGAEVKKPGASVKVSCKAS  GYAFTNYLIE WVRQAPGQGLEWMG VINPGSGGIY YAQKFQGRVTMTRDTSTSTVYMELSSLRSEDTAVYYCAR
h5381H2  QVQLVQSGAEVKKPGASVKVSCKAS  GYAFTNYLIE WVRQAPGQGLEWIG VINPGSGGIY YAQKFQGRVTMTRDTSTSTVYMELSSLRSEDTAVYYCAR
h5381H3  QVQLVQSGAEVKKPGASVKVSCKTS  GYAFTNYLIE WVRQAPGQGLEWIG VINPGSGGIY YAQKFQGRVTMTADTSTSTAYMELSSLRSEDTAVYYCAR
h5381H4  QVQLVQSGAEVKKPGASVKVSCKTS  GYAFTNYLIE WVRQAPGQGLEWIG VINPGSGGIY YAQKFQGRVTLTADKSSTAYMELSSLRSEDTAVYYCAR
                           V                                    #              N   T                         F seq       100        110
AbM                  110
              i     b b b
538_1    SETHDTWFAY WGQGTLVTVSA   (SEQ ID NO: 1771)
         *                        ("1-46*01" sequence is disclosed as SEQ ID NO: 1772)
h5381H1  SETHDTWFAY WGQGTLVTVSS   (SEQ ID NO: 1773)
h5381H2  SETHDTWFAY WGQGTLVTVSS   (SEQ ID NO: 1774)
h5381H3  SETHDTWFAY WGQGTLVTVSS   (SEQ ID NO: 1775)
h5381H4  SETHDTWFAY WGQGTLVTVSS   (SEQ ID NO: 1776)
            @
```

\# deamidation substitutions: Q/S/A
@ tryptophan oxidation substitutions: Y/F/H

Figure 63QQQ
humanized sequences of CHA.7.538_1 antibody VL

Potential humanized sequence based on IMGT IGKV1-39*01 acceptor framework
IGKV1-39*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 1777)

Joining region IMGT J00242|IGKJ2*01|YTFGQGTKLEIK (SEQ ID NO: 1778)

IGKV1-17*02
DIQMTQSPSSLSASVGDRVTITCRASQGIRNDLGWYQQKPGKAPKRLIYAASSLQSGVPSRFSGSGSGTEFTLTISNLQPEDFATYYCLQHNSYPP (SEQ ID NO: 1779)

```
seq                        10         20         30         40         50         60         70         80
AbM      b  b  b    p p      p b b    b  bi bi i    ii ibbi    i          b  b          b  b    ib bib
538      DIVMTQSQKFISTSVGDRVTITCRASQSISSYLN WFQQKPGQSPKALIY LASTRHT GVPDRFTGSSGSGTDFTLTISNVQSEDLADYFC
              *    ****     *                  *          **         *   *            **    * **  * *
IGKV1-39 DIQMTQSPSSLSASVGDRVTITC KASQSISSYLN WYQQKPGKAPK&LLIY AASSLQS GVPSRFSGSGSGTDFTLTISSLQPEDFATYYC
h538L1   DIQMTQSPSSLSASVGDRVTITC KASQSVRIAVA WYQQKPGKAPKLLIY LASTRHT GVPSRFSGSGSGTDFTLTISSLQPEDFATYYC
h538L2   DIQMTQSPSSLSASVGDRVTITC KASQSVRIAVA WFQQKPGKAPK&LIY LASTRHT GVPSRFSGSGSGTDFTLTISSVQPEDFATYYC
              I T                                      S                                      L   F seq       90         100
AbM       ibi  iib i  b b b
538       LQHWNYPYT FGGGTKLEIK (SEQ ID NO: 1780)
             @#
IGKV1-39  QQSYSTPP (SEQ ID NO: 1781)
             *
h538L1    LQHWNYPYT FGQGTKLEIK (SEQ ID NO: 1782)
h538L2    LQHWNYPYT FGQGTKLEIK (SEQ ID NO: 1783)
             @#
```

\# deamidation substitutions: Q/S/A/D
@ tryptophan oxidation substitutions: Y/F/H

Figure 63RRR
humanized sequences of CHA.7.538_2 antibody VH

Potential humanized sequence based on IMGT IGHV1-46*01 acceptor framework
IGHV1-46*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR (SEQ ID NO: 1784)
Joining region
IMGT J00256|IGHJ4*01|YFDYWGQGTLVTVSS (SEQ ID NO: 1785)

```
seq              10         20         30         40         50         60         70         80         90
AbM              10         20         30         40         50    a    60         70         80  abc      90
                 b b b      p b b b    b b  b b bi i  ibb b     ibb b           i  b b b b x   b b b    b   bibibb
538_2          QVQLQQSGAELVRPGTSVKMSCKAA GYTFTNYWIG WVKQRPGHGLEWIG DIYPGGGYTN YNEKFKGKATLTADTSSTAYMQLSSLTSEDSAIYYCAS
                  *  *         ***  *  *  *         *               *  *       **  *  * *  **    *  **  *  *
1-46*01        QVQLVQSGAEVKKPGASVKVSCKAS GYTFTSYYMH WVRQAPGQGLEWMG IINPSGGSTS YAQKFQGRVTMTRDTSTSTVYMELSSLRSEDTAVYYCAR
h5382H1        QVQLVQSGAEVKKPGASVKVSCKAS GYTFTNYWIG WVRQAPGQGLEWMG DIYPGGGYTN YAQKFQGRVTMTRDTSTSTVYMELSSLRSEDTAVYYCAR
h5382H2        QVQLVQSGAEVKKPGASVKVSCKAS GYTFTNYWIG WVRQAPGQGLEWIG DIYPGGGYTN YAQKFQGRVTMTRDTSTSTVYMELSSLRSEDTAVYYCAR
h5382H3        QVQLVQSGAEVKKPGASVKMSCKAS GYTFTNYWIG WVRQAPGQGLEWIG DIYPGGGYTN YAQKFQGRATLTADTSTSTAYMELSSLRSEDTAVYYCAS
                               V                             #  @                   N                   I seq           100        110
AbM           100        110
                         i b b b
538_2         PYYGSSYGFAF WGQGTLVTVSA (SEQ ID NO: 1786)
                 *                     ("1-46*01" sequence is disclosed as SEQ ID NO: 1787)
h5382H1       PYYGSSYGFAF WGQGTLVTVSS (SEQ ID NO: 1788)
h5382H2       PYYGSSYGFAF WGQGTLVTVSS (SEQ ID NO: 1789)
h5382H3       PYYGSSYGFAF WGQGTLVTVSS (SEQ ID NO: 1790)
```

\# deamidation substitutions: Q/S/A
@ tryptophan oxidation substitutions: Y/F/H

Figure 63SSS

Potential humanized sequence based on IMGT IGHV1-46*01 acceptor framework (AbM CDR definition)
IGHV1-46*01 QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
(SEQ ID NO: 1791)

Joining region IMGT J00256|IGHJ4*01|YFDYWGQGTLVTVSS (SEQ ID NO: 1792)

```
seq                    10         20         30         40         50          60         70         80         90
AbM         b b b      p       b b b b  b b     b b    b i i     i b b b  a    i   b b b b x    b b b b     b b b b    b i b i b b
            *          *       * *      *     * ******  *                 *    *   * * * *   * *   *        * * *  *          *          *  *
524         QVQLQQSGPEVVRPGVSVKISCKGS   GYKFPDYVMH  WVKQSHAKSLEWIG IISIYSGNTN YNQKFKGKATMTVDKSSSTAYMELARLTSEDSAIYYCAR 1-46*01     QVQLVQSGAEVKKPGASVKVSCKAS   GYTFTSYYMH  WVRQAPGQGLEWMG IINPSGGSTS YAQKFQGRVTMTRDTSTSTVYMELSSLRSEDTAVYYCAR
h524H1      QVQLVQSGAEVKKPGASVKVSCKAS   GYKFPDYVMH  WVRQAPGQGLEWIG IISIYSGNTN YAQKFQGRVTMTRDTSTSTVYMELSSLRSEDTAVYYCAR
h524H2      QVQLVQSGAEVKKPGASVKVSCKAS   GYKFPDYVMH  WVRQAPGQGLEWIG IISIYSGNTN YAQKFQGRVTMTVDTSTSTVYMELSSLRSEDTAVYYCAR
h524H3      QVQLVQSGAEVKKPGASVKISCKGS   GYKFPDYVMH  WVRQAPGQGLEWIG IISIYSGNTN YAQKFQGRATMTVDTSTSTAYMELSSLRSEDTAVYYCAR
h524H4      QVQLVQSGAEVKKPGASVKISCKGS   GYKFPDYVMH  WVRQAPGQGLEWIG IISIYSGNTN YAQKFQGRATMTVDKSTAYMELSSLRSEDTAVYYCAR
                             V                                                    # #    N                                   I seq         100           110
AbM                     i   b b b
                        *
524         EGDLPMFAY  WGQGTLVTVSS  (SEQ ID NO: 1793)
                  @                 ("1-46*01" sequence disclosed as SEQ ID NO: 1794)
h524H1      EGDLPMFAY  WGQGTLVTVSS  (SEQ ID NO: 1795)
h524H2      EGDLPMFAY  WGQGTLVTVSS  (SEQ ID NO: 1796)
h524H3      EGDLPMFAY  WGQGTLVTVSS  (SEQ ID NO: 1797)
h524H4      EGDLPMFAY  WGQGTLVTVSS  (SEQ ID NO: 1798)
```

\# deamidation substitutions: Q/S/A
@ methionine oxidation substitutions: L/F/A

Figure 63TTT

Potential humanized sequence based on IMGT IGKV3-11*01 acceptor framework (AbM CDR definition)
IGKV3-11*01 EIVLTQSPATLSLSPGERATLSCRASQSVSSYLAWYQQKPGQAPRLLIYDASNRATGIPARFSGSGSGTDFTLTISSLEPEDFAVYYCQQRSNWPP (SEQ ID NO: 1799)

Joining region IMGT J00242|IGKJ2*01|YTFGQGTKLEIK (SEQ ID NO: 1800)

```
seq              10         20         30         40         50         60         70         80
AbM              10         20         30         40         50         60         70         80
                 bbb     pp bbb b  b  bi b  bi bi i  ii ibbi          i          b  b     bbb b   ib bib
524              QIVLTQSPAIMSASPGEKVTMTC NASSSVS-YMY WYQQKPISSPRLLIY DTSNLAS GVPVRFSGSGSGTSYSLTIGRMEAEDAATYYC
                 *         ** **               ***           ***             * *          *** *** * *
IGKV3-11         EIVLTQSPATLSLSPGERATLSC RASQVSSYLA WYQQKPGQAPRLLIY DASNRAT GIPARFSGSGSGTDFTLTISSLEPEDFAVYYC
h524L1           EIVLTQSPATLSLSPGERATLSC NASSSVS-YMY WYQQKPGQAPRLLIY DTSNLAS GIPARFSGSGSGTDFTLTISSLEPEDFAVYYC
h524L2           EIVLTQSPATLSLSPGERATLSC NASSSVS-YMY WYQQKPGQAPRLLIY DTSNLAS GIPARFSGSGSGTDYTLTISSLEPEDFAVYYC
h524L3           EIVLTQSPATLSLSPGERVTMSC NASSSVS-YMY WYQQKPGQAPRLLIY DTSNLAS GVPARFSGSGSGTDYTLTISSMEPEDFAVYYC
                                  M A          #                      S                                  A seq              90        100
AbM              90        100
                 ibi iib i  bbb
524              QQWSSYPLT FGAGTKVEVK (SEQ ID NO: 1801)
                                *  *
IGKV3-11         QQRSNWPP                (SEQ ID NO: 1802)
h524L1           QQWSSYPLT FGQGTKLEIK (SEQ ID NO: 1803)
h524L2           QQWSSYPLT FGQGTKLEIK (SEQ ID NO: 1804)
h524L3           QQWSSYPLT FGQGTKVEIK (SEQ ID NO: 1805)
                                V
                 @
```

\# deamidation substitutions: Q/S/A/D
@ tryptophan oxidation substitutions: Y/F/H

Figure 63UUU

Potential humanized sequence based on IMGT IGHV1-46*01 acceptor framework (AbM CDR definition)
IGHV1-46*01 QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR
(SEQ ID NO: 1806)

Joining region IMGT J00256|IGHJ4*01|YFDYWGQGTLVTVSS (SEQ ID NO: 1807)

```
seq          10         20         30         40         50         60         70         80         90
AbM          10         20         30         40         50  a      60         70         80  abc    90  bibibb
530          b b b      p  b b b b      b b          b b i i    i bb b        i b  b b b x       b b b  b          *  *  *  *  *  *
             QVQLQQSGAELMRPGTSVKVSCKAS GYAFTNHLIE WIKQRPGQGLEWIG VINPGSDSTD YNEKFKDKATLTADKSSTAYMQLSSLTSDDSAVYFCAR
             *  *  *          *               *                 *           * *  *  *  *                *   *   *  *

1-46*01      QVQLVQSGAEVKKPGASVKVSCKAS GYTFTFTSYYMH WVRQAPGQGLEWMG IINPGGGSTS YAQKFQGRVTMTRDTSTSTVYMELSSLRSEDTAVYYCAR
h530H1       QVQLVQSGAEVKKPGASVKVSCKAS GYAFTNHLIE WVRQAPGQGLEWMG VINPGSDSTD YAQKFQGRVTMTRDTSTSTVYMELSSLRSEDTAVYYCAR
h530H2       QVQLVQSGAEVKKPGASVKVSCKAS GYAFTNHLIE WVRQAPGQGLEWIG VINPGSDSTD YAQKFQGRVTMTRDTSTSTVYMELSSLRSEDTAVYYCAR
h530H3       QVQLVQSGAEVKKPGASVKVSCKAS GYAFTNHLIE WIRQAPGQGLEWIG VINPGSDSTD YAQKFQGRVTMTADTSTSTAYMELSSLRSEDTAVYYCAR
h530H4       QVQLVQSGAEVKKPGASVKVSCKAS GYAFTNHLIE WIRQAPGQGLEWIG VINPGSDSTD YAQKFQGRATLTADKSTSTAYMELSSLRSEDTAVYYCAR
                                                                     #           M                   N                                    F
```

```
seq          100        110
AbM                     110
530                     i  b b b
             SLYYNSWFVY WGQGTLVTVSA (SEQ ID NO: 1808)
                                   * ("1-46*01" sequence disclosed as SEQ ID NO: 1809)
h530H1       SLYYNSWFVY WGQGTLVTVSS (SEQ ID NO: 1810)
h530H2       SLYYNSWFVY WGQGTLVTVSS (SEQ ID NO: 1811)
h530H3       SLYYNSWFVY WGQGTLVTVSS (SEQ ID NO: 1812)
h530H4       SLYYNSWFVY WGQGTLVTVSS (SEQ ID NO: 1813)
               # @
```

\# deamidation substitutions: Q/S/A
@ tryptophan oxidation substitutions: Y/F/H

Figure 63VVV

Potential humanized sequence based on IMGT IGKV1-39*01 acceptor framework (AbM CDR definition)
IGKV1-39*01 DIQMTQSPSSLSASVGDRVTITCRASQSISSYLNWYQQKPGKAPKLLIYAASSLQSGVPSRFSGSGSGTDFTLTISSLQPEDFATYYCQQSYSTPP (SEQ ID NO: 1814) Joining region IMGT J00242|IGKJ2*01|YTFGQGTKLEIK (SEQ ID NO: 1815)

```
                      10         20         30         40         50         60         70         80
seq                   10         20         30         40         50         60         70         80
AbM         b b b  p p   p b b  b   b  b   bi bi  i   ii ibbi      i     b  b      b b b  b    ib bib
530         DIQMTQSPASLSASVGETVTITC WYQQKRGKSPQLLVY             GVPSRFSGSGSGTQFSLKINSLQPEDFGSYYC
                       *     *  *              *   *   *                     * * * *          * **

IGKV1-39    DIQMTQSPSSLSASVGDRVTITC RASQSISSYLN  WYQQKPGKAPKLLIY AASSLQS     GVPSRFSGSGSGTDFTLTISSLQPEDF&TYYC
h530L1      DIQMTQSPSSLSASVGDRVTITC RASENIYSYLA  WYQQKPGKAPKLLIY NAKTLVE     GVPSRFSGSGSGTDFTLTISSLQPEDFATYYC
h530L2      DIQMTQSPSSLSASVGDRVTITC RASENIYSYLA  WYQQKPGKAPKLLVY NAKTLVE     GVPSRFSGSGSGTDFTLTISSLQPEDF&TYYC
                                         #                       #

90         100
seq                   90         100
AbM         ibi  iib  i  b b b
530         QHHYGTPYT FGGGTKLEIK (SEQ ID NO: 1816)
                         *

IGKV1-39    QQSYSTPP            (SEQ ID NO: 1817)
h530L1      QHHYGTPYT FGQGTKLEIK (SEQ ID NO: 1818)
h530L2      QHHYGTPYT FGQGTKLEIK (SEQ ID NO: 1819)
```

\# deamidation substitutions: Q/S/A/D

Figure 63WWW

| What | Sequences |
|---|---|
| humanized CHA.7.518 VH h518HH1 | QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSS<br><br>(SEQ ID NO: 1820) |
| humanized CHA.7.518 VH h518HH2 | QVQLVQSGAEVKKPGASVKVSCKASGYTFTDYNINWVRQAPGQGLEWIGYIYPYIGGSGYAQKFQGRVTMTADTSTSTVYMELSSLRSEDTAVYYCAREDKTARNAMDYWGQGTLVTVSS<br><br>(SEQ ID NO: 1821) |
| humanized CHA.7.518 VH h518HH3 | QVQLVQSGAEVKKPGASVKISCKASGYTFTDYNINWVRQAPGQGLEWIGYIYPYIGGSGYAQKFQGRATLTADTSTSTAYMELSSLRSEDTAVYYCAREDKTARNAMDYWGQGTLVTVSS<br><br>(SEQ ID NO: 1822) |
| humanized CHA.7.518 VH h518HH4 | QVQLVQSGAEVKKPGASVKISCKASGYTFTDYNINWVRQAPGQGLEWIGYIYPYIGGSGYAQKFQGRATLTADNSTSTAYMELSSLRSEDTAVYYCAREDKTARNAMDYWGQGTLVTVSS<br><br>(SEQ ID NO: 1823) |
| humanized CHA.7.518 VL h518HL1 | DIQMTQSPSSLSASVGDRVTITCRVSENIYSNLAWYQQKPGKAPKLLIYEATNLAEGVPSRFSGSGSGTDFTLTISSLQPEDFATYYCQHFWGTPYTFGQGTKLEIK<br><br>(SEQ ID NO: 1824) |
| humanized CHA.7.518 VL h518HL2 | DIQMTQSPSSLSASVGDRVTITCRVSENIYSNLAWYQQKPGKAPKLLIYEATNLAEGVPSRFSGSGSGTDYTLTISSLQPEDFATYYCQHFWGTPYTFGQGTKLEIK<br><br>(SEQ ID NO: 1825) |
| humanized CHA.7.518 VL h518HL3 | DIQMTQSPSSLSASVGDRVTITCRVSENIYSNLAWYQQKPGKAPKLLVYEATNLAEGVPSRFSGSGSGTDYTLTISSLQPEDFGTYYCQHFWGTPYTFGQGTKLEIK<br><br>(SEQ ID NO: 1826) |

Figure 63XXX

| What | Sequences |
|---|---|
| humanized CHA.7.538_1 VH h5381HH1 | QVQLVQSGAEVKKPGASVKVSCKASGYAFTNYLIEWVRQAPGQGLEWMGVINPGSGGIYYAQKFQGRVTMTRDTSTSTVYMELSSLRSEDTAVYYCARSETHDTWFAYWGQGTLVTVSS (SEQ ID NO: 1827) |
| humanized CHA.7.538_1 VH h5381HH2 | QVQLVQSGAEVKKPGASVKVSCKASGYAFTNYLIEWVRQAPGQGLEWIGVINPGSGGIYYAQKFQGRVTMFADTSTSTVYMELSSLRSEDTAVYYCARSETHDTWFAYWGQGTLVTVSS (SEQ ID NO: 1828) |
| humanized CHA.7.538_1 VH h5381HH3 | QVQLVQSGAEVKKPGASVKVSCKTSGYAFTNYLIEWVRQAPGQGLEWIGVINPGSGGIYYAQKFQGRVTLTADTSTSTAYMELSSLRSEDTAVYYCARSETHDTWFAYWGQGTLVTVSS (SEQ ID NO: 1829) |
| humanized CHA.7.538_1 VH h5381HH4 | QVQLVQSGAEVKKPGASVKVSCKTSGYAFTNYLIEWVRQAPGQGLEWIGVINPGSGGIYYAQKFQGRVTLTADKSTSTAYMELSSLRSEDTAVYYCARSETHDTWFAYWGQGTLVTVSS (SEQ ID NO: 1830) |
| humanized CHA.7.538_1/538_2 VL h538HL1 | DIQMTQSPSSLSASVGDRVTITCKASQSVRIAVAWYQQKPGKAPKLLIYLASTRHTGVPSRFSGSGSGTDFTLTISSLQPEDFATYYCLQHWNYPYTFGQGTKLEIK (SEQ ID NO: 1831) |
| humanized CHA.7.538_1/538_2 VL h538HL2 | DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIK (SEQ ID NO: 1832) |

Figure 63YYY

| What | Sequences |
|---|---|
| humanized CHA.7.538_2 VH h5382HH1 | QVQLVQSGAEVKKPGASVKVSCKASGYTFNYWIGWVRQAPGQGLEWMGDIYPGGGYTNYAQKF QGRVTMTRDTSTSTVYMELSSLRSEDTAVYYCARPYYGSSYGFAFWGQGTLVTVSS<br><br>(SEQ ID NO: 1833) |
| humanized CHA.7.538_2 VH h5382HH2 | QVQLVQSGAEVKKPGASVKVSCKASGYTFNYWIGWVRQAPGQGLEWIGDIYPGGGYTNYAQKFQ GRVTMTADTSTSTVYMELSSLRSEDTAVYYCASPYYGSSYGFAFWGQGTLVTVSS<br><br>(SEQ ID NO: 1834) |
| humanized CHA.7.538_2 VH h5382HH3 | QVQLVQSGAEVKKPGASVKMSCKASGYTFNYWIGWVRQAPGQGLEWIGDIYPGGGYTNYAQKFQ GRATLTADTSTSTAYMELSSLRSEDTAVYYCASPYYGSSYGFAFWGQGTLVTVSS<br><br>(SEQ ID NO: 1835) |
| humanized CHA.7.538_1/538_2 VL h538HL1 | DIQMTQSPSSLSASVGDRVTITCKASQSVRIAVAWYQQKPGKAPKLLIYLASTRHTGVPSRFSGSGSGT DFTLTISSLQPEDFATYYCLQHWNYPYTFGQGTKLEIK<br><br>(SEQ ID NO: 1836) |
| humanized CHA.7.538_1/538_2 VL h538HL2 | DIQMTQSPSSLSASVGDRVTITCKASQSVRIAVAWFQQKPGKAPKALIYLASTRHTGVPSRFSGSGSGT DFTLTISSVQPEDFATYYCLQHWNYPYTFGQGTKLEIK<br><br>(SEQ ID NO: 1837) |

Figure 63ZZZ

| What | Sequences |
|---|---|
| humanized CHA.7.524 VH h524H1 | QVQLVQSGAEVKKPGASVKVSCKASGYKFPDYVMHWVRQAPGQGLEWMGIISIYSGNTNYAQKFQGRV TMTRDTSTSTVYMELSSLRSEDTAVYYCAREGDLPMFAYWGQGTLVTVSS (SEQ ID NO: 1838) |
| humanized CHA.7.524 VH h524H2 | QVQLVQSGAEVKKPGASVKVSCKASGYKFPDYVMHWVRQAPGQGLEWIGIISIYSGNTNYAQKFQGRVT MTVDTSTSTVYMELSSLRSEDTAVYYCAREGDLPMFAYWGQGTLVTVSS (SEQ ID NO: 1839) |
| humanized CHA.7.524 VH h524H3 | QVQLVQSGAEVKKPGASVKISCKGSGYKFPDYVMHWVRQAPGQGLEWIGIISIYSGNTNYAQKFQGRAT MTVDTSTSTAYMELSSLRSEDTAVYYCAREGDLPMFAYWGQGTLVTVSS (SEQ ID NO: 1840) |
| humanized CHA.7.524 VH h524H4 | QVQLVQSGAEVKKPGASVKISCKGSGYKFPDYVMHWVRQAPGQGLEWIGIISIYSGNTNYAQKFQGRAT MTVDKSTSTAYMELSSLRSEDTAVYYCAREGDLPMFAYWGQGTLVTVSS (SEQ ID NO: 1841) |
| humanized CHA.7.524 VL h524L1 | EIVLTQSPATLSLSPGERATLSCNASSSVSYMYWYQQKPGQAPRLLIYDTSNLASGIPARFSGSGSGTDFTLT ISSLEPEDFAVYYCQQWSSYPLTFGQGTKLEIK (SEQ ID NO: 1842) |
| humanized CHA.7.524 VL h524L2 | EIVLTQSPATLSLSPGERATLSCNASSSVSYMYWYQQKPGQAPRLLIYDTSNLASGIPARFSGSGSGTDYTL TISSLEPEDFAVYYCQQWSSYPLTFGQGTKLEIK (SEQ ID NO: 1843) |
| humanized CHA.7.524 VL h524L3 | EIVLTQSPATLSLSPGERVTMSCNASSSVSYMYWYQQKPGQAPRLLIYDTSNLASGVPARFSGSGSGTDYT LTISSMEPEDFAVYYCQQWSSYPLTFGQGTKVEIK (SEQ ID NO: 1844) |

Figure 63AAAA

| What | Sequences |
|---|---|
| humanized CHA.7.530 VH h530H1 | QVQLVQSGAEVKKPGASVKVSCKASGYAFTNHLIEWVRQAPGQGLEWMGVINPGSDSTDYAQKFQGRVTMTRDTSTSTVYMELSSLRSEDTAVYYCARSLYYNSWFVYWGQGTLVTVSS (SEQ ID NO: 1845) |
| humanized CHA.7.530 VH h530H2 | QVQLVQSGAEVKKPGASVKVSCKASGYAFTNHLIEWVRQAPGQGLEWIGVINPGSDSTDYAQKFQGRVTMTADTSTSTVYMELSSLRSEDTAVYYCARSLYYNSWFVYWGQGTLVTVSS (SEQ ID NO: 1846) |
| humanized CHA.7.530 VH 530H3 | hQVQLVQSGAEVKKPGASVKVSCKASGYAFTNHLIEWIRQAPGQGLEWIGVINPGSDSTDYAQKFQGRATLTADTSTSTAYMELSSLRSEDTAVYYCARSLYYNSWFVYWGQGTLVTVSS (SEQ ID NO: 1847) |
| humanized CHA.7.530 VH h530H4 | QVQLVQSGAEVKKPGASVKVSCKASGYAFTNHLIEWIRQAPGQGLEWIGVINPGSDSTDYAQKFQGRATLTADKSTSTAYMELSSLRSEDTAVYYCARSLYYNSWFVYWGQGTLVTVSS (SEQ ID NO: 1848) |
| humanized CHA.7.530 VL h530L1 | DIQMTQSPSSLSASVGDRVTITCRASENIYSYLAWYQQKPGKAPKLLIYNAKTLVEGVPSRFSGSGSGTDFTLTISSLQPEDFATYYCQHHYGTPYTFGQGTKLEIK (SEQ ID NO: 1849) |
| humanized CHA.7.530 VL h530L2 | DIQMTQSPSSLSASVGDRVTITCRASENIYSYLAWYQQKPGKAPKLLVYNAKTLVEGVPSRFSGSGSGTDFTLTISSLQPEDFGTYYCQHHYGTPYTFGQGTKLEIK (SEQ ID NO: 1850) |

TRIPLE COMBINATION ANTIBODY THERAPIES

CROSS REFERENCE TO RELATED APPLICATIONS

This application claims priority under 35 U.S.C. § 119 to U.S. Patent Application Nos. 62/513,960 filed Jun. 1, 2017, 62/515,452 filed Jun. 5, 2017, 62/538,563 filed Jul. 28, 2017, 62/547,051 filed Aug. 17, 2017, 62/582,756 filed Nov. 7, 2017 and 62/618,005 filed Jan. 16, 2018, all of which are expressly incorporated herein by reference in their entireties.

SEQUENCE LISTING

The instant application contains a Sequence Listing which has been submitted electronically in ASCII format and is hereby incorporated by reference in its entirety. Said ASCII copy, created on Jul. 30, 2018, is named 114386-5009-US_SL.txt and is 1,476,473 bytes in size.

I. BACKGROUND OF THE INVENTION

TIGIT is a coinhibitory receptor that is highly expressed on effector & regulatory (Treg) CD4+ T cells, effector CD8+ T cells, and NK cells. TIGIT has been shown to attenuate immune response by (1) direct signaling, (2) inducing ligand signaling, and (3) competition with and disruption of signaling by the costimulatory receptor CD226 (also known as DNAM-1). TIGIT signaling has been the most well-studied in NK cells, where it has been demonstrated that engagement with its cognate ligand, poliovirus receptor (PVR, also known as CD155) directly suppresses NK cell cytotoxicity through its cytoplasmic ITIM domain. Knockout of the TIGIT gene or antibody blockade of the TIGIT/PVR interaction has shown to enhance NK cell killing in vitro, as well as to exacerbate autoimmune diseases in vivo. In addition to its direct effects on T- and NK cells, TIGIT can induce PVR-mediated signaling in dendritic or tumor cells, leading to the increase in production of anti-inflammatory cytokines such as IL10. In T-cells TIGIT can also inhibit lymphocyte responses by disrupting homodimerization of the costimulatory receptor CD226, and by competing with it for binding to PVR.

TIGIT is highly expressed on lymphocytes, including Tumor Infiltrating Lymphocytes (TILs) and Tregs, that infiltrate different types of tumors. PVR is also broadly expressed in tumors, suggesting that the TIGIT-PVR signaling axis may be a dominant immune escape mechanism for cancer. Notably, TIGIT expression is tightly correlated with the expression of another important coinhibitory receptor, PD1. TIGIT and PD1 are co-expressed on the TILs of numerous human and murine tumors. Unlike TIGIT and CTLA4, PD1 inhibition of T cell responses does not involve competition for ligand binding with a costimulatory receptor.

The immune checkpoint, poliovirus receptor related immunoglobulin domain containing (PVRIG, also known as CD112R) represents a new inhibitory receptor within the TIGIT family of receptors. PVRIG binds with high affinity to its cognate ligand, poliovirus receptor-related 2 (PVRL2, also known as CD112 or nectin-2) to deliver an inhibitory signal through its ITIM motif within T and NK cells. The affinity of TIGIT to PVR and of PVRIG to PVRL2 is higher than the affinity of CD226 to either PVR or PVRL2, suggesting TIGIT and PVRIG can outcompete PVR and PVRL2 from CD226 and providing an indirect mechanism by which TIGIT and PVRIG can reduce lymphocyte function. Thus, two receptors with the same family, TIGIT and PVRIG, deliver inhibitory signals to dampen T and NK cell responses.

Accordingly, TIGIT and PVRIG are attractive for triple therapy combinations with checkpoint inhibitors, including anti-PD-1 antibodies.

II. BRIEF SUMMARY OF THE INVENTION

The present invention provides methods and compositions comprising combinations of the TIGIT antibodies as disclosed herein and as provided in the claims with PVRIG antibodies and checkpoint inhibitors, including anti-PD-1 antibodies. The present invention also provides for nucleic acids encoding said antibodies and compositions thereof.

The present invention provides a method of treating cancer said patient comprising: a) providing a biopsy from said patient comprising tumor cells; b) measuring the frequency of PD-L1 positive tumor cells or immune cells in said biopsy; c) if said frequency of PD-L1 positive tumor cells or immune cells is greater than 1% compared to staining the same tumor cells with a relevant isotype control antibody for the antibodies used, administering a triple combination therapy comprising an anti-TIGIT antibody, an anti-PVRIG antibody and an anti-PD-1 antibody; and d) if said frequency of PD-L1 positive tumor cells or immune cells is less than 1% compared to staining the same tumor cells with a relevant isotype control antibody for the antibodies used, administering a double combination therapy comprising an anti-TIGIT antibody and an anti-PVRIG antibody.

In some embodiments of the method, anti-TIGIT antibody is an antibody chosen from at least one of CPA.9.083.H4 (S241P), CPA.9.086.H4(S241P), CHA.9.547.7.H4(S241P) and CHA.9.547.13.H4(S241P).

In some embodiments of the method, anti-PVRIG antibody is an antibody chosen from at least one of CHA.7.518.1.H4(S241P) and CHA.7.538.1.2.H4(S241P).

In some embodiments of the method, the anti-PD-1 antibody is an antibody chosen from at least one of pembrolizumab, cemiplimab, and nivolumab.

In some embodiments of the method, the double combination therapy is chosen from the administration of CPA.9.083.H4(S241P) and CHA.7.518.1.H4(S241P); CPA.9.086.H4(S241P) and CHA.7.518.1.H4(S241P); CHA.9.547.7.H4(S241P) and CHA.7.518.1.H4(S241P); CHA.9.547.13.H4(S241P) and CHA.7.518.1.H4(S241P); CPA.9.083.H4(S241P) and CHA.7.538.1.2.H4(S241P); CPA.9.086.H4(S241P) and CHA.7.538.1.2.H4(S241P); CHA.9.547.7.H4(S241P) and CHA.7.538.1.2.H4(S241P); and CHA.9.547.13.H4(S241P) and CHA.7.538.1.2.H4 (S241P).

In some embodiments of the method, the triple combination therapy is chosen from the administration of CPA.9.083.H4(S241P), pembrolizumab and CHA.7.518.1.H4(S241P); CPA.9.086.H4(S241P), pembrolizumab and CHA.7.518.1.H4(S241P); CHA.9.547.7.H4 (S241P), pembrolizumab and CHA.7.518.1.H4(S241P); CHA.9.547.13.H4(S241P), pembrolizumab and CHA.7.518.1.H4(S241P); CPA.9.083.H4(S241P), pembrolizumab and CHA.7.538.1.2.H4(S241P); CPA.9.086.H4 (S241P), pembrolizumab and CHA.7.538.1.2.H4(S241P); CHA.9.547.7.H4(S241P), pembrolizumab and CHA.7.538.1.2.H4(S241P); CHA.9.547.13.H4(S241P), pembrolizumab and CHA.7.538.1.2.H4(S241P); CPA.9.083.H4(S241P), nivolumab and CHA.7.518.1.H4

(S241P); CPA.9.086.H4(S241P), nivolumab and CHA.7.518.1.H4(S241P); CHA.9.547.7.H4(S241P), nivolumab and CHA.7.518.1.H4(S241P); CHA.9.547.13.H4(S241P), nivolumab and CHA.7.518.1.H4(S241P); CPA.9.083.H4(S241P), nivolumab and CHA.7.538.1.2.H4(S241P); CPA.9.086.H4(S241P), nivolumab and CHA.7.538.1.2.H4(S241P); CHA.9.547.7.H4(S241P, nivolumab and CHA.7.538.1.2.H4(S241P); CHA.9.547.13.H4(S241P), nivolumab and CHA.7.538.1.2.H4(S241P); CHA.7.538.1.2.H4(S241P); CPA.9.083.H4(S241P), cemiplimab and CHA.7.518.1.H4(S241P); CPA.9.086.H4(S241P), cemiplimab and CHA.7.518.1.H4(S241P); CHA.9.547.7.H4(S241P), cemiplimab and CHA.7.518.1.H4(S241P); CHA.9.547.13.H4(S241P), cemiplimab and CHA.7.518.1.H4(S241P); CPA.9.083.H4(S241P), cemiplimab and CHA.7.538.1.2.H4(S241P); CPA.9.086.H4(S241P), cemiplimab and CHA.7.538.1.2.H4(S241P); CHA.9.547.7.H4(S241P, cemiplimab and CHA.7.538.1.2.H4(S241P); and CHA.9.547.13.H4(S241P), cemiplimab and CHA.7.538.1.2.H4(S241P).

In some embodiments of the method, the antibodies are administered simultaneously.

In some embodiments of the method, the antibodies are administered sequentially.

In some embodiments of the method, the cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS). In some embodiments of the method, the cancer is selected from the group consisting of cancer triple negative breast cancer, stomach (gastric) cancer, lung cancer (small cell lung, non-small cell lung), Merkel Cells cancer, MSI-high cancer, KRAS mutant tumors, adult T-cell leukemia/lymphoma, and Myelodysplastic syndromes (MDS). In some embodiments of the method, the cancer is selected from the group consisting of cancer triple negative breast cancer, stomach (gastric) cancer, lung cancer (small cell lung, non-small cell lung), Merkel Cells cancer, and MSI-high cancer.

The present invention also provides a method of treating cancer said patient comprising administering a triple combination therapy comprising an anti-TIGIT antibody, an anti-PVRIG antibody, and an anti-PD-1 antibody.

In some embodiments of the method, the anti-TIGIT antibody is an antibody chosen from at least one of CPA.9.083.H4(S241P), CPA.9.086.H4(S241P), CHA.9.547.7.H4(S241P), and CHA.9.547.13.H4(S241P).

In some embodiments of the method, the anti-PVRIG antibody is an antibody chosen from at least one of CHA.7.518.1.H4(S241P) and CHA.7.538.1.2.H4(S241P).

In some embodiments of the method, the anti-PD-1 antibody is an antibody chosen from at least one of pembrolizumab, cemiplimab and nivolumab.

In some embodiments of the method, the triple combination therapy comprises the administration of an anti-PD-1 antibody in combination with a double-combination therapy chosen from the administration of CPA.9.083.H4(S241P) and CHA.7.518.1.H4(S241P); CPA.9.086.H4(S241P) and CHA.7.518.1.H4(S241P); CHA.9.547.7.H4(S241P) and CHA.7.518.1.H4(S241P); CHA.9.547.13.H4(S241P) and CHA.7.518.1.H4(S241P); CPA.9.083.H4(S241P) and CHA.7.538.1.2.H4(S241P); CPA.9.086.H4(S241P) and CHA.7.538.1.2.H4(S241P); CHA.9.547.7.H4(S241P) and CHA.7.538.1.2.H4(S241P); and CHA.9.547.13.H4(S241P) and CHA.7.538.1.2.H4(S241P).

In some embodiments of the method, the triple combination therapy is chosen from the administration of CPA.9.083.H4(S241P), pembrolizumab and CHA.7.518.1.H4(S241P); CPA.9.086.H4(S241P), pembrolizumab and CHA.7.518.1.H4(S241P); CHA.9.547.7.H4(S241P), pembrolizumab and CHA.7.518.1.H4(S241P); CHA.9.547.13.H4(S241P), pembrolizumab and CHA.7.518.1.H4(S241P); CPA.9.083.H4(S241P), pembrolizumab and CHA.7.538.1.2.H4(S241P); CPA.9.086.H4(S241P), pembrolizumab and CHA.7.538.1.2.H4(S241P); CHA.9.547.7.H4(S241P), pembrolizumab and CHA.7.538.1.2.H4(S241P); CHA.9.547.13.H4(S241P), pembrolizumab and CHA.7.538.1.2.H4(S241P); CPA.9.083.H4(S241P), nivolumab and CHA.7.518.1.H4(S241P); CPA.9.086.H4(S241P), nivolumab and CHA.7.518.1.H4(S241P); CHA.9.547.7.H4(S241P), nivolumab and CHA.7.518.1.H4(S241P); CHA.9.547.13.H4(S241P), nivolumab and CHA.7.518.1.H4(S241P); CPA.9.083.H4(S241P), nivolumab and CHA.7.538.1.2.H4(S241P); CPA.9.086.H4(S241P), nivolumab and CHA.7.538.1.2.H4(S241P); CHA.9.547.7.H4(S241P, nivolumab and CHA.7.538.1.2.H4(S241P); CHA.9.547.13.H4(S241P), nivolumab and CHA.7.538.1.2.H4(S241P); CHA.7.538.1.2.H4(S241P); CPA.9.083.H4(S241P), cemiplimab and CHA.7.518.1.H4(S241P); CPA.9.086.H4(S241P), cemiplimab and CHA.7.518.1.H4(S241P); CHA.9.547.7.H4(S241P), cemiplimab and CHA.7.518.1.H4(S241P); CHA.9.547.13.H4(S241P), cemiplimab and CHA.7.518.1.H4(S241P); CPA.9.083.H4(S241P), cemiplimab and CHA.7.538.1.2.H4(S241P); CPA.9.086.H4(S241P), cemiplimab and CHA.7.538.1.2.H4(S241P); CHA.9.547.7.H4(S241P, cemiplimab and CHA.7.538.1.2.H4(S241P); and CHA.9.547.13.H4(S241P), cemiplimab and CHA.7.538.1.2.H4(S241P).

In some embodiments of the method, the antibodies are administered simultaneously.

In some embodiments of the method, the antibodies are administered sequentially.

In some embodiments of the method, the cancer for the triple combination therapy is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS). In some embodiments of the method, the cancer is selected from the group consisting of cancer triple negative breast cancer, stomach (gastric) cancer, lung cancer (small cell lung, non-small cell lung), Merkel Cells cancer, MSI-high cancer, KRAS mutant tumors, adult T-cell leukemia/lymphoma, and Myelodysplastic syndromes (MDS).

The present invention also provides a pharmaceutical dose kit comprising: a) a container comprising a unit dosage of an anti-TIGIT antibody; and b) a container comprising a unit dosage of an anti-PVRIG antibody.

The present invention also provides a pharmaceutical dose kit comprising: a) a container comprising a unit dosage of an anti-TIGIT antibody; b) a container comprising a unit dosage of an anti-PVRIG antibody; and c) a container comprising an anti-PD-1 antibody.

In a further aspect, the invention provides methods comprising: a) providing a cell population from a tumor sample from a patient; b) staining said population with labeled antibodies that bind: i) TIGIT protein; ii) PVRIG protein; iii) PVR protein; iv) PD-1 protein; v) PD-L1 protein; vi) PVRL2; and vi) a relevant isotype control for the antibodies in i)-vi); c) running fluorescence activated cell sorting (FACS); d) for each of TIGIT, PVRIG, PVR, PD-1, PVRL2 and PD-L1, determining the percentage of cells in said population that express the protein relative to said isotype control antibody; wherein if the percentage of positive cells is >1% for either TIGIT or PVR, and for either PVRIG or PVRL2, and for either PD-1 or PD-L1, proceeding to step e); and e) administering antibodies to TIGIT, PVRIG, and PD-1 to said patient.

In a further aspect, the invention provides methods comprising: a) providing a cell population from a tumor sample from a patient; b) staining said population with labeled antibodies that bind: i) TIGIT protein; ii) PVR protein; iii) PD-1 protein; iv) PD-L1 protein; and v) a relevant isotype control for the antibodies in i)-iv); c) running fluorescence activated cell sorting (FACS); d) for each of TIGIT, PVR, PD-1, and PD-L1, determining the percentage of cells in said population that express the protein relative to said isotype control antibody; wherein if the percentage of positive cells is ≥1% for all 4 receptors, e) administering antibodies to TIGIT and PD-1 to said patient.

In an additional aspect, the invention provides methods comprising: a) providing a cell population from a tumor sample from a patient; b) staining said population with labeled antibodies that bind: i) PVRIG protein; ii) PVRL2 protein; iii) PD-1 protein; iv) PD-L1 protein; and v) a relevant isotype control for the antibodies in i)-iv); c) running fluorescence activated cell sorting (FACS); d) for each of PVRIG, PVRL2, PD-1 and PD-L1, determining the percentage of cells in said population that express the protein relative to said isotype control antibody; wherein if the percentage of positive cells is ≥1% for all 4 receptors, e) administering antibodies to PVRIG and PD-1 to said patient.

In a further aspect, the invention provides methods comprising a) providing a cell population from a tumor sample from a patient; b) staining said population with labeled antibodies that bind: i) PVRIG protein; ii) PVRL2 protein; iii) TIGIT protein; iv) PVR protein; and v) a relevant isotype control for the antibodies in i)-iv); c) running fluorescence activated cell sorting (FACS); d) for each of PVRIG, PVRL2, TIGIT and PVR, determining the percentage of cells in said population that express the protein relative to said isotype control antibody; wherein if the percentage of positive cells is ≥1% for all 4 receptors, e) administering antibodies to PVRIG and TIGIT to said patient.

In an additional aspect, the invention provides methods comprising: a) providing a cell population from a tumor sample from a patient; b) staining said population with labeled antibodies that bind: i) PVRIG protein; ii) TIGIT protein; iii) PVRL2 protein; iv) PD-1 protein; v) PD-L1 protein; and vi) a relevant isotype control for the antibodies in i)-v); c) running fluorescence activated cell sorting (FACS); d) for each of PVRIG, TIGIT, PVRL2, PD-1 and PD-L1, determining the percentage of cells in said population that express the protein relative to said isotype control antibody; wherein if the percentage of positive cells is ≥1% for all 5 receptors, e) administering antibodies to PVRIG, TIGIT, and PD-1 to said patient.

In a further aspect, the invention provides methods comprising a) providing a cell population from a tumor sample from a patient; b) staining said population with labeled antibodies that bind: i) PVRIG protein; ii) PVRL2 protein; iii) TIGIT protein; iv) PVR protein; v) PD-1; and vi) a relevant isotype control for the antibodies in i)-v); c) running fluorescence activated cell sorting (FACS); d) for each of PVRIG, PVRL2, TIGIT and PVR, determining the percentage of cells in said population that express the protein relative to said isotype control antibody; wherein if the percentage of positive cells is ≥1% for all 4 receptors, e) administering antibodies to PVRIG, TIGIT, and PD-1 to said patient.

In some embodiments, the present invention provides a method of treating cancer in a patient comprising: a) providing a biopsy from said patient comprising tumor cells; b) measuring the frequency of PD-L1 positive tumor cells or immune cells in said biopsy; c) if said frequency of PD-L1 positive tumor cells or immune cells is greater than 1% compared to staining the same tumor cells with a relevant isotype control antibody for the antibodies used, administering a triple combination therapy comprising an anti-TIGIT antibody, an anti-PVRIG antibody and an anti-PD-1 antibody; and d) if said frequency of PD-L1 positive tumor cells or immune cells is less than 1% compared to staining the same tumor cells with a relevant isotype control antibody for the antibodies used, administering a double combination therapy comprising an anti-TIGIT antibody and an anti-PVRIG antibody.

In some embodiments, the anti-TIGIT antibody is an antibody chosen from any anti-TIGIT antibody described herein, including any of those described in FIG. 3.

3 In some embodiments, the anti-PVRIG antibody is an antibody chosen from any anti-PVRIG antibody described herein, including any of those described in FIG. 5 and/or FIG. 63.

In some embodiments, the anti-PD-1 antibody is an antibody chosen from any anti-PD-1 antibody described herein, including any of those described in FIG. 7.

In some embodiments, the anti-TIGIT antibody is an antibody chosen from at least one of CPA.9.083.H4(S241P), CPA.9.086.H4(S241P), CHA.9.547.7.H4(S241P), and CHA.9.547.13.H4(S241P).

In some embodiments, the anti-PVRIG antibody is an antibody chosen from at least one of CHA.7.518.1.H4(S241P) and CHA.7.538.1.2.H4(S241P).

In some embodiments, the anti-PD-1 antibody is an antibody chosen from at least one of pembrolizumab, Cemiplimab and nivolumab.

8 In some embodiments, the double combination therapy is chosen from the administration of CPA.9.083.H4(S241P) and CHA.7.518.1.H4(S241P); CPA.9.086.H4(S241P) and CHA.7.518.1.H4(S241P); CHA.9.547.7.H4(S241P) and CHA.7.518.1.H4(S241P); CHA.9.547.13.H4(S241P) and CHA.7.518.1.H4(S241P); CPA.9.083.H4(S241P) and CHA.7.538.1.2.H4(S241P); CPA.9.086.H4(S241P) and CHA.7.538.1.2.H4(S241P); CHA.9.547.7.H4(S241P) and CHA.7.538.1.2.H4(S241P); and CHA.9.547.13.H4(S241P) and CHA.7.538.1.2.H4(S241P).

In some embodiments, the triple combination therapy is chosen from the administration of CPA.9.083.H4(S241P), pembrolizumab and CHA.7.518.1.H4(S241P); CPA.9.086.H4(S241P), pembrolizumab and CHA.7.518.1.H4(S241P); CHA.9.547.7.H4(S241P), pembrolizumab and CHA.7.518.1.H4(S241P); CHA.9.547.13.H4(S241P), pembrolizumab and CHA.7.518.1.H4(S241P); CPA.9.083.H4(S241P), pembrolizumab and CHA.7.538.1.2.H4(S241P); CPA.9.086.H4(S241P), pembrolizumab and CHA.7.538.1.2.H4(S241P); CHA.9.547.7.H4(S241P), pembrolizumab and CHA.7.538.1.2.H4(S241P); CHA.9.547.13.H4(S241P), pembrolizumab and CHA.7.538.1.2.H4(S241P); CPA.9.083.H4(S241P), nivolumab and CHA.7.518.1.H4(S241P); CPA.9.086.H4(S241P), nivolumab and CHA.7.518.1.H4(S241P); CHA.9.547.7.H4(S241P), nivolumab and CHA.7.518.1.H4(S241P); CHA.9.547.13.H4(S241P), nivolumab and CHA.7.518.1.H4(S241P); CPA.9.083.H4(S241P), nivolumab and CHA.7.538.1.2.H4(S241P); CPA.9.086.H4(S241P), nivolumab and CHA.7.538.1.2.H4(S241P); CHA.9.547.7.H4(S241P, nivolumab and CHA.7.538.1.2.H4(S241P); CHA.9.547.13.H4(S241P), nivolumab and CHA.7.538.1.2.H4(S241P); CHA.7.538.1.2.H4(S241P); CPA.9.083.H4(S241P), cemiplimab and CHA.7.518.1.H4(S241P); CPA.9.086.H4(S241P), cemiplimab and CHA.7.518.1.H4(S241P); CHA.9.547.7.H4(S241P), cemiplimab and CHA.7.518.1.H4(S241P); CHA.9.547.13.H4(S241P), and CHA.9.547.13.H4(S241P), and CHA.7.518.1.H4(S241P); CPA.9.083.H4(S241P), cemiplimab and CHA.7.538.1.2.H4(S241P); CPA.9.086.H4(S241P), cemiplimab and CHA.7.538.1.2.H4(S241P); CHA.9.547.7.H4(S241P, cemiplimab and CHA.7.538.1.2.H4(S241P); and CHA.9.547.13.H4(S241P), cemiplimab and CHA.7.538.1.2.H4(S241P).

In some embodiments, the antibodies are administered simultaneously.

In some embodiments, the antibodies are administered sequentially.

In some embodiments, the cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS).

In some embodiments, the cancer is selected from the group consisting of triple negative breast cancer, stomach (gastric) cancer, lung cancer (small cell lung, non-small cell lung), and Merkel Cells cancer, MSI-high cancer KRAS mutant tumors, adult T-cell leukemia/lymphoma, and Myelodysplastic syndromes (MDS).

In some embodiments, the present invention provides a method of treating cancer in a patient comprising administering a triple combination therapy comprising an anti-TIGIT antibody, an anti-PVRIG antibody, and an anti-PD-1 antibody.

In some embodiments, the anti-TIGIT antibody is an antibody chosen from at least one of CPA.9.083.H4(S241P), CPA.9.086.H4(S241P), CHA.9.547.7.H4(S241P), and CHA.9.547.13.H4(S241P).

In some embodiments, the said anti-PVRIG antibody is an antibody chosen from at least one of CHA.7.518.1.H4(S241P) and CHA.7.538.1.2.H4(S241P).

1 In some embodiments, the anti-PD-1 antibody is an antibody selected from the group consisting of pembrolizumab, cemiplimab, and nivolumab.

In some embodiments, the triple combination therapy comprises the administration of an anti-PD-1 antibody in combination with a double-combination therapy chosen from the administration of CPA.9.083.H4(S241P) and CHA.7.518.1.H4(S241P); CPA.9.086.H4(S241P) and CHA.7.518.1.H4(S241P); CHA.9.547.7.H4(S241P) and CHA.7.518.1.H4(S241P); CHA.9.547.13.H4(S241P) and CHA.7.518.1.H4(S241P); CPA.9.083.H4(S241P) and CHA.7.538.1.2.H4(S241P); CPA.9.086.H4(S241P) and CHA.7.538.1.2.H4(S241P); CHA.9.547.7.H4(S241P) and CHA.7.538.1.2.H4(S241P); and CHA.9.547.13.H4(S241P) and CHA.7.538.1.2.H4(S241P).

In some embodiments, the triple combination therapy is chosen from the administration of CPA.9.083.H4(S241P), pembrolizumab and CHA.7.518.1.H4(S241P); CPA.9.086.H4(S241P), pembrolizumab and CHA.7.518.1.H4(S241P); CHA.9.547.7.H4(S241P), pembrolizumab and CHA.7.518.1.H4(S241P); CHA.9.547.13.H4(S241P), pembrolizumab and CHA.7.518.1.H4(S241P); CPA.9.083.H4(S241P), pembrolizumab and CHA.7.538.1.2.H4(S241P); CPA.9.086.H4(S241P), pembrolizumab and CHA.7.538.1.2.H4(S241P); CHA.9.547.7.H4(S241P), pembrolizumab and CHA.7.538.1.2.H4(S241P); CHA.9.547.13.H4(S241P), pembrolizumab and CHA.7.538.1.2.H4(S241P); CPA.9.083.H4(S241P), nivolumab and CHA.7.518.1.H4(S241P); CPA.9.086.H4(S241P), nivolumab and CHA.7.518.1.H4(S241P); CHA.9.547.7.H4(S241P), nivolumab and CHA.7.518.1.H4(S241P); CHA.9.547.13.H4(S241P), nivolumab and CHA.7.518.1.H4(S241P); CPA.9.083.H4(S241P), nivolumab and CHA.7.538.1.2.H4(S241P); CPA.9.086.H4(S241P), nivolumab and CHA.7.538.1.2.H4(S241P); CHA.9.547.7.H4(S241P, nivolumab and CHA.7.538.1.2.H4(S241P); CHA.9.547.13.H4(S241P), nivolumab and CHA.7.538.1.2.H4(S241P); CHA.7.538.1.2.H4(S241P); CPA.9.083.H4(S241P), cemiplimab and CHA.7.518.1.H4(S241P); CPA.9.086.H4(S241P), cemiplimab and CHA.7.518.1.H4(S241P); CHA.9.547.7.H4(S241P), cemiplimab and CHA.7.518.1.H4(S241P); CHA.9.547.13.H4(S241P), cemiplimab and CHA.7.518.1.H4(S241P); CPA.9.083.H4(S241P), cemiplimab and CHA.7.538.1.2.H4(S241P); CPA.9.086.H4(S241P), cemiplimab and CHA.7.538.1.2.H4(S241P); CHA.9.547.7.H4(S241P, cemiplimab and CHA.7.538.1.2.H4(S241P); and CHA.9.547.13.H4(S241P), cemiplimab and CHA.7.538.1.2.H4(S241P).

In some embodiments, the antibodies are administered simultaneously.

In some embodiments, the antibodies are administered sequentially.

In some embodiments, the cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS).

In some embodiments, the cancer is selected from the group consisting of triple negative breast cancer, stomach (gastric) cancer, lung cancer (small cell lung, non-small cell lung), and Merkel Cells cancer, MSI-high cancer, KRAS mutant tumors, adult T-cell leukemia/lymphoma, and Myelodysplastic syndromes (MDS).

In some embodiments, the present invention provides a pharmaceutical dose kit comprising: a) a container comprising a unit dosage of an anti-TIGIT antibody; and b) a container comprising a unit dosage of an anti-PVRIG antibody.

In some embodiments, the present invention provides a pharmaceutical dose kit comprising: a) a container comprising a unit dosage of an anti-TIGIT antibody; b) a container comprising a unit dosage of an anti-PVRIG antibody; and c) a container comprising an anti-PD-1 antibody.

In some embodiments, the anti-TIGIT antibody is an antibody chosen from any anti-TIGIT antibody described herein, including any of those described in FIG. 3.

In some embodiments, the anti-PVRIG antibody is an antibody chosen from any anti-PVRIG antibody described herein, including any of those described in FIG. 5 and/or FIG. 63.

In some embodiments, the anti-PD-1 antibody is an antibody chosen from any anti-PD-1 antibody described herein, including any of those described in FIG. 7.

In some embodiments, the present invention provides a method comprising: a) providing a cell population from a tumor sample from a patient; b) staining said population with labeled antibodies that bind: i) TIGIT protein; ii) PVRIG protein; iii) PVR protein; iv) PD-1 protein; v) PD-L1 protein; and vi) a relevant isotype control for the antibodies in i)-v); c) running fluorescence activated cell sorting (FACS); d) for each of TIGIT, PVRIG, PVR, PD-1 and PD-L1, determining the percentage of cells in said population that express the protein relative to said isotype control antibody; wherein if the percentage of positive cells is >1% for all 5 receptors, e) administering antibodies to TIGIT, PVRIG, and PD-1 to said patient.

In some embodiments, the anti-TIGIT antibody is an antibody chosen from any anti-TIGIT antibody described herein, including any of those described in FIG. 3.

In some embodiments, the anti-PVRIG antibody is an antibody chosen from any anti-PVRIG antibody described herein, including any of those described in FIG. 5 and/or FIG. 63.

In some embodiments, the anti-PD-1 antibody is an antibody chosen from any anti-PD-1 antibody described herein, including any of those described in FIG. 7.

In some embodiments, the TIGIT antibody is CPA.9.086.

In some embodiments, the PD-1 antibody is selected from pembrolizumab and nivolumab.

In some embodiments, the PVRIG antibody is CHA.7.518.1.H4(S241P).

In some embodiments, the present invention provides a method comprising: a) providing a cell population from a tumor sample from a patient; b) staining said population with labeled antibodies that bind: i) PVRIG protein; ii) TIGIT protein; iii) PVRL2 protein; iv) PD-1 protein; v) PD-L1 protein; and vi) a relevant isotype control for the antibodies in i)-v); c) running fluorescence activated cell sorting (FACS); d) for each of PVRIG, TIGIT, PVRL2, PD-1 and PD-L1, determining the percentage of cells in said population that express the protein relative to said isotype control antibody; wherein if the percentage of positive cells is >1% for all 5 receptors, e) administering antibodies to PVRIG and PD-1 to said patient.

In some embodiments, the anti-TIGIT antibody is an antibody chosen from any anti-TIGIT antibody described herein, including any of those described in FIG. 3.

In some embodiments, the anti-PVRIG antibody is an antibody chosen from any anti-PVRIG antibody described herein, including any of those described in FIG. 5 and/or FIG. 63.

In some embodiments, the anti-PD-1 antibody is an antibody chosen from any anti-PD-1 antibody described herein, including any of those described in FIG. 7.

In some embodiments, the anti-PD-L1 antibody is an antibody chosen from any anti-PD-L1 antibody described herein, including any of those described in FIG. 62.

In some embodiments, the PVRIG antibody is CHA.7.518.1.H4(S241P).

In some embodiments, the PD-1 antibody is selected from pembrolizumab and nivolumab.

In some embodiments, the TIGIT antibody is CPA.9.086.

In some embodiments, the present invention provides a method comprising: a) providing a cell population from a tumor sample from a patient; b) staining said population with labeled antibodies that bind: i) PVRIG protein; ii) PD-1 protein; iii) PVRL2 protein; iv) TIGIT protein; v) PVR protein; and vi) a relevant isotype control for the antibodies in i)-v); c) running fluorescence activated cell sorting (FACS); d) for each of PVRIG, PVRL2, TIGIT and PVR, determining the percentage of cells in said population that express the protein relative to said isotype control antibody; wherein if the percentage of positive cells is >1% for all 5 receptors, e) administering antibodies to PVRIG and TIGIT to said patient.

In some embodiments, the anti-TIGIT antibody is an antibody chosen from any anti-TIGIT antibody described herein, including any of those described in FIG. 3.

In some embodiments, the anti-PVRIG antibody is an antibody chosen from any anti-PVRIG antibody described herein, including any of those described in FIG. 5 and/or FIG. 63.

In some embodiments, the anti-PD-1 antibody is an antibody chosen from any anti-PD-1 antibody described herein, including any of those described in FIG. 7.

In some embodiments, the anti-PD-L1 antibody is an antibody chosen from any anti-PD-L1 antibody described herein, including any of those described in FIG. 62.

In some embodiments, the PVRIG antibody is CHA.7.518.1.H4(S241P).

In some embodiments, the TIGIT antibody is CPA9.086.

In some embodiments, the PD-1 antibody is selected from pembrolizumab and nivolumab.

In some embodiments, the present invention provides a method of treating cancer in a patient comprising: a) providing a biopsy from said patient comprising tumor cells; b) measuring the frequency of PD-L1 positive tumor cells or immune cells in said biopsy; c) if said frequency of PD-L1 positive tumor cells or immune cells is greater than 1% compared to staining the same tumor cells with a relevant isotype control antibody for the antibodies used, administering a triple combination therapy comprising an anti- TIGIT antibody, an anti-PVRIG antibody and an anti-PD-L1 antibody; and d) if said frequency of PD-L1 positive tumor cells or immune cells is less than 1% compared to staining the same tumor cells with a relevant isotype control antibody for the antibodies used, administering a double combination therapy comprising an anti-TIGIT antibody and an anti-PVRIG antibody.

In some embodiments, the anti-TIGIT antibody is an antibody chosen from any anti-TIGIT antibody described herein, including any of those described in FIG. 3.

In some embodiments, the anti-PVRIG antibody is an antibody chosen from any anti-PVRIG antibody described herein, including any of those described in FIG. 5 and/or FIG. 63.

In some embodiments, the anti-PD-1 antibody is an antibody chosen from any anti-PD-L1 antibody described herein, including any of those described in FIG. 62.

In some embodiments, the anti-TIGIT antibody is an antibody chosen from at least one of CPA.9.083.H4(S241P), CPA.9.086.H4(S241P), CHA.9.547.7.H4(S241P), and CHA.9.547.13.H4(S241P).

In some embodiments, the anti-PVRIG antibody is an antibody chosen from at least one of CHA.7.518.1.H4 (S241P) and CHA.7.538.1.2.H4(S241P).

58. A method according to any one of claims 52 to 57, wherein said anti-PD-L1 antibody is an antibody chosen from at least one of atezolizumab, avelumab, and durvalumab.

In some embodiments, the double combination therapy is chosen from the administration of CPA.9.083.H4(S241P) and CHA.7.518.1.H4(S241P); CPA.9.086.H4(S241P) and CHA.7.518.1.H4(S241P); CHA.9.547.7.H4(S241P) and CHA.7.518.1.H4(S241P); CHA.9.547.13.H4(S241P) and CHA.7.518.1.H4(S241P); CPA.9.083.H4(S241P) and CHA.7.538.1.2.H4(S241P); CPA.9.086.H4(S241P) and CHA.7.538.1.2.H4(S241P); CHA.9.547.7.H4(S241P) and CHA.7.538.1.2.H4(S241P); and CHA.9.547.13.H4(S241P) and CHA.7.538.1.2.H4(S241P).

In some embodiments, the triple combination therapy is chosen from the administration of CPA.9.083.H4(S241P), atezolizumab and CHA.7.518.1.H4(S241P); CPA.9.086.H4 (S241P), atezolizumab and CHA.7.518.1.H4(S241P); CHA.9.547.7.H4(S241P), atezolizumab and CHA.7.518.1.H4(S241P); CHA.9.547.13.H4(S241P), atezolizumab and CHA.7.518.1.H4(S241P); CPA.9.083.H4 (S241P), atezolizumab and CHA.7.538.1.2.H4(S241P); CPA.9.086.H4(S241P), atezolizumab and CHA.7.538.1.2.H4(S241P); CHA.9.547.7.H4(S241P), atezolizumab and CHA.7.538.1.2.H4(S241P); CHA.9.547.13.H4(S241P), atezolizumab and CHA.7.538.1.2.H4(S241P); CPA.9.083.H4(S241P), avelumab and CHA.7.518.1.H4(S241P); CPA.9.086.H4 (S241P), avelumab and CHA.7.518.1.H4(S241P); CHA.9.547.7.H4(S241P), avelumab and CHA.7.518.1.H4 (S241P); CHA.9.547.13.H4(S241P), avelumab and CHA.7.518.1.H4(S241P); CPA.9.083.H4(S241P), avelumab and CHA.7.538.1.2.H4(S241P); CPA.9.086.H4 (S241P), avelumab and CHA.7.538.1.2.H4(S241P); CHA.9.547.7.H4(S241P, avelumab and CHA.7.538.1.2.H4 (S241P); and CHA.9.547.13.H4(S241P), avelumab and CHA.7.538.1.2.H4(S241P); CPA.9.083.H4(S241P), durvalumab and CHA.7.518.1.H4(S241P); CPA.9.086.H4 (S241P), durvalumab and CHA.7.518.1.H4(S241P); CHA.9.547.7.H4(S241P), durvalumab and CHA.7.518.1.H4(S241P); CHA.9.547.13.H4(S241P), durvalumab and CHA.7.518.1.H4(S241P); CPA.9.083.H4 (S241P), durvalumab and CHA.7.538.1.2.H4(S241P); CPA.9.086.H4(S241P), durvalumab and CHA.7.538.1.2.H4 (S241P); CHA.9.547.7.H4(S241P, durvalumab and CHA.7.538.1.2.H4(S241P); and CHA.9.547.13.H4(S241P), durvalumab and CHA.7.538.1.2.H4(S241P).

In some embodiments, the antibodies are administered simultaneously.

In some embodiments, the antibodies are administered sequentially.

In some embodiments, the cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS).

In some embodiments, the cancer is selected from the group consisting of triple negative breast cancer, stomach (gastric) cancer, lung cancer (small cell lung, non-small cell lung), and Merkel Cells cancer, MSI-high cancer, KRAS mutant tumors, adult T-cell leukemia/lymphoma, and Myelodysplastic syndromes (MDS).

In some embodiments, the present invention provides a method of treating cancer in a patient comprising administering a triple combination therapy comprising an anti-TIGIT antibody, an anti-PVRIG antibody, and an anti-PD-L1 antibody.

In some embodiments, the anti-TIGIT antibody is an antibody chosen from at least one of CPA.9.083.H4(S241P), CPA.9.086.H4(S241P), CHA.9.547.7.H4(S241P), and CHA.9.547.13.H4(S241P).

In some embodiments, the anti-PVRIG antibody is an antibody chosen from at least one of CHA.7.518.1.H4 (S241P) and CHA.7.538.1.2.H4(S241P).

In some embodiments, the anti-PD-L1 antibody is an antibody selected from the group consisting of atezolizumab, avelumab, and durvalumab.

In some embodiments, the triple combination therapy comprises the administration of an anti-PD-L1 antibody in combination with a double-combination therapy chosen from the administration of CPA.9.083.H4(S241P) and CHA.7.518.1.H4(S241P); CPA.9.086.H4(S241P) and CHA.7.518.1.H4(S241P); CHA.9.547.7.H4(S241P) and CHA.7.518.1.H4(S241P); CHA.9.547.13.H4(S241P) and CHA.7.518.1.H4(S241P); CPA.9.083.H4(S241P) and CHA.7.538.1.2.H4(S241P); CPA.9.086.H4(S241P) and CHA.7.538.1.2.H4(S241P); CHA.9.547.7.H4(S241P) and CHA.7.538.1.2.H4(S241P); and CHA.9.547.13.H4(S241P) and CHA.7.538.1.2.H4(S241P).

In some embodiments, the triple combination therapy is chosen from the administration of CPA.9.083.H4(S241P), atezolizumab and CHA.7.518.1.H4(S241P); CPA.9.086.H4 (S241P), atezolizumab and CHA.7.518.1.H4(S241P); CHA.9.547.7.H4(S241P), atezolizumab and CHA.7.518.1.H4(S241P); CHA.9.547.13.H4(S241P), atezolizumab and CHA.7.518.1.H4(S241P); CPA.9.083.H4 (S241P), atezolizumab and CHA.7.538.1.2.H4(S241P); CPA.9.086.H4(S241P), atezolizumab and CHA.7.538.1.2.H4(S241P); CHA.9.547.7.H4(S241P), atezolizumab and CHA.7.538.1.2.H4(S241P);

CHA.9.547.13.H4(S241P), atezolizumab and CHA.7.538.1.2.H4(S241P); CPA.9.083.H4(S241P), avelumab and CHA.7.518.1.H4(S241P); CPA.9.086.H4 (S241P), avelumab and CHA.7.518.1.H4(S241P); CHA.9.547.7.H4(S241P), avelumab and CHA.7.518.1.H4 (S241P); CHA.9.547.13.H4(S241P), avelumab and CHA.7.518.1.H4(S241P); CPA.9.083.H4(S241P), avelumab and CHA.7.538.1.2.H4(S241P); CPA.9.086.H4 (S241P), avelumab and CHA.7.538.1.2.H4(S241P); CHA.9.547.7.H4(S241P, avelumab and CHA.7.538.1.2.H4 (S241P); and CHA.9.547.13.H4(S241P), avelumab and CHA.7.538.1.2.H4(S241P); CPA.9.083.H4(S241P), durvalumab and CHA.7.518.1.H4(S241P); CPA.9.086.H4 (S241P), durvalumab and CHA.7.518.1.H4(S241P); CHA.9.547.7.H4(S241P), durvalumab and CHA.7.518.1.H4(S241P); CHA.9.547.13.H4(S241P), durvalumab and CHA.7.518.1.H4(S241P); CPA.9.083.H4 (S241P), durvalumab and CHA.7.538.1.2.H4(S241P); CPA.9.086.H4(S241P), durvalumab and CHA.7.538.1.2.H4 (S241P); CHA.9.547.7.H4(S241P, durvalumab and CHA.7.538.1.2.H4(S241P); and CHA.9.547.13.H4(S241P), durvalumab and CHA.7.538.1.2.H4(S241P).

In some embodiments, the antibodies are administered simultaneously.

In some embodiments, the antibodies are administered sequentially.

In some embodiments, the cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS).

In some embodiments, the cancer is selected from the group consisting of triple negative breast cancer, stomach (gastric) cancer, lung cancer (small cell lung, non-small cell lung), and Merkel Cells cancer, MSI-high cancer, KRAS mutant tumors, adult T-cell leukemia/lymphoma, and Myelodysplastic syndromes (MDS).

III. BRIEF DESCRIPTION OF THE DRAWINGS

FIG. 1A-1B depicts the amino acid sequences of the constant domains of human IgG1 (with some useful amino acid substitutions), IgG2, IgG3, IgG4, IgG4 with a hinge variant that finds particular use in the present invention, and the constant domains of the kappa and lambda light chains.

FIG. 2 depicts the sequence of human and cynomolgus macaque (referred to as cyno) TIGIT, PVRIG and PD-1 proteins.

FIG. 3A-3PPPP depicts the sequences of four anti-Tigit Antibodies that block the interaction of TIGIT and PVR, CPA.9.083.H4(S241P), CPA,9.086.H4(S241P), CHA.9.547.7.H4(S241P) and CHA.9.547.13.H4(S241P), as well as benchmark antibodies, BM26 and BM29, and numerous other anti-TIGIT antibodies.

Figure 4A:
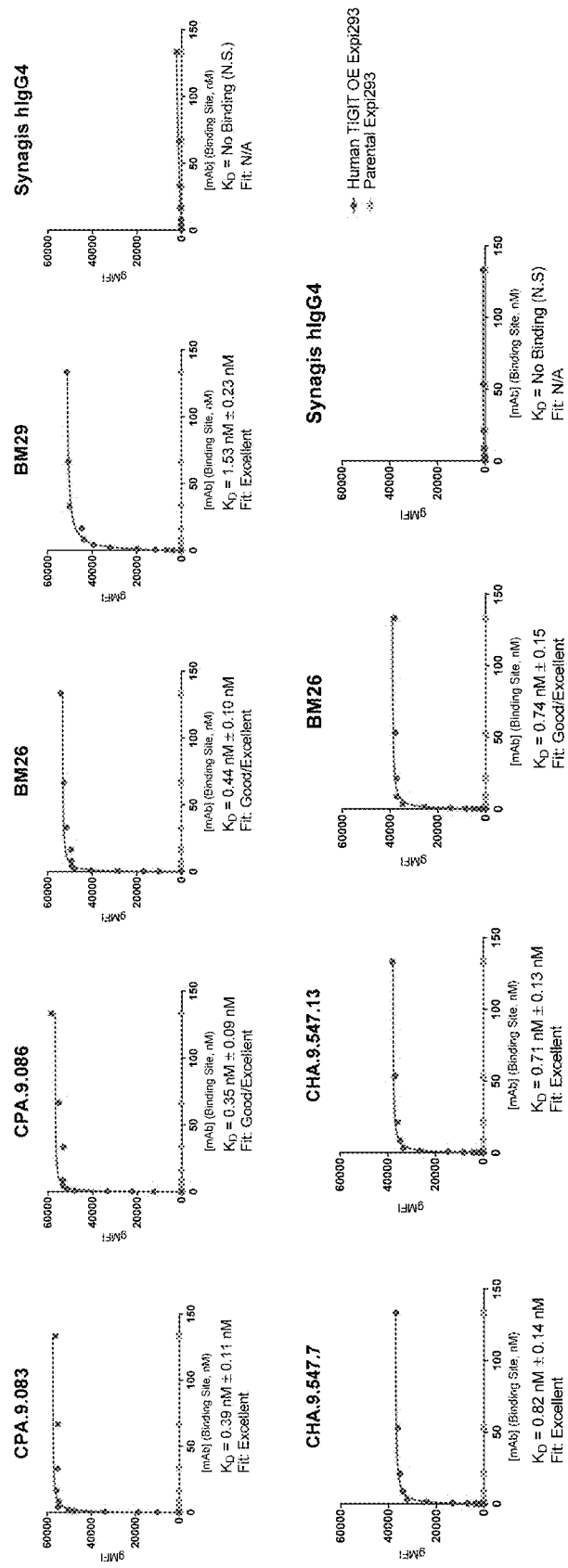
Figure 4B:
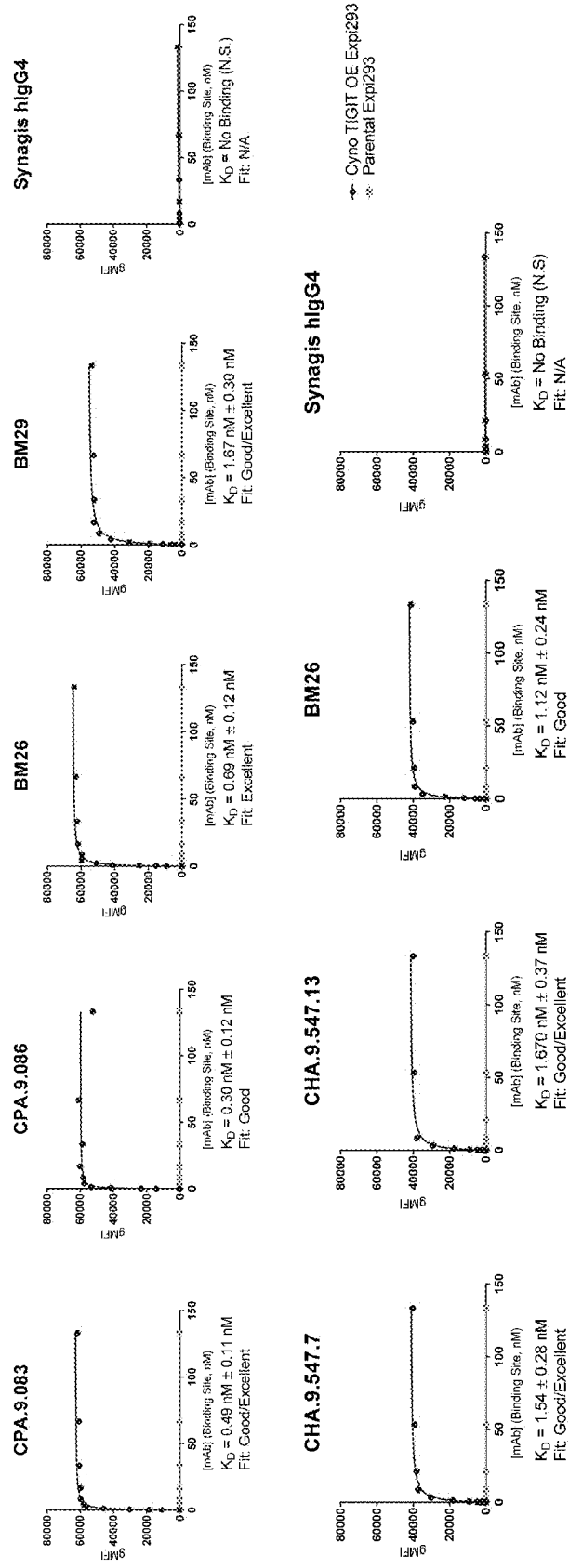
Figure 4C:
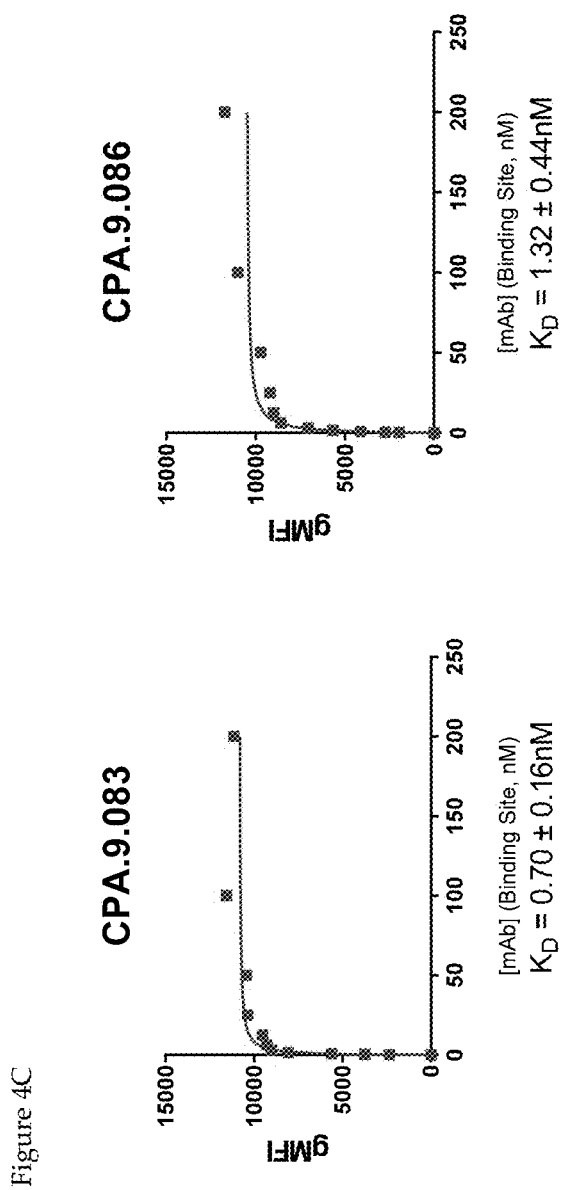

FIG. 4A-4C shows the FACS $K_D$ results of anti-TIGIT antibodies (CPA.9.083.H4(S241P), CPA.9.086.H4(S241P), CHA.9.547.7.H4(S241P), and CHA.9.547.13.H4(S241P), as well as benchmark antibodies, BM26 and BM29, binding to human (A), cynomolgus (B), and mouse (C) TIGIT over-expressing Expi293 HEK cells.

FIG. 5A-5F depicts the sequences of two anti-PVRIG antibodies, CHA.7.518.1.H4(S241P) and CHA.7.538.1.2.H4(S241P). Other PVRIG antibodies are provided in FIG. 63.

Figure 6:
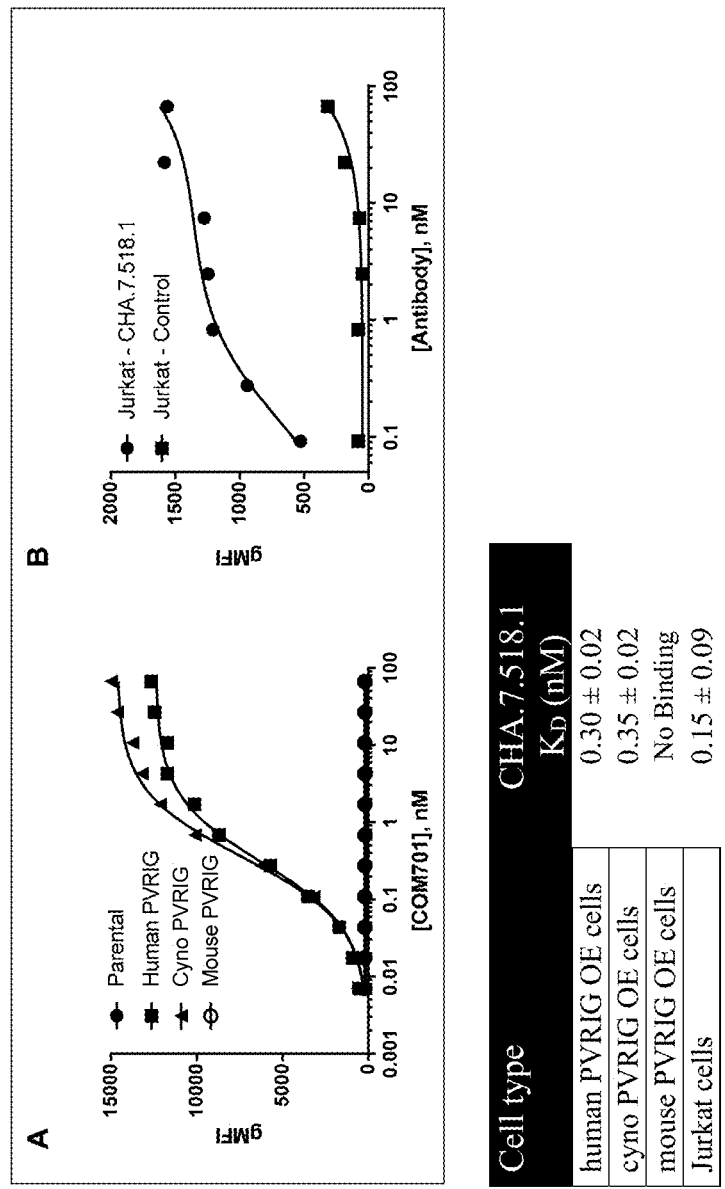

FIG. 6 shows the binding of CHA.7.518.1.H4(S241P) to PVRIG by flow cytometry. (A) Binding to PVRIG over-expressing HEK293 cells. CHA.7.518.1.H4(S241P) binds human and cynomolgus PVRIG over-expressing HEK293 cells but not the mouse PVRIG over-expressing or parental HEK293 cells. (B) Binding of CHA.7.518.1.H4(S241P) to Jurkat cells. Specific binding is observed for CHA.7.518.1.H4(S241P) but not for an irrelevant isotype control antibody. Dissociation constant ($K_D$) for CHA.7.518.1.H4(S241P) binding to targets expressed on cells are listed in the table.

FIG. 7A-7F depicts the sequences of two anti-PD-1 antibodies.

FIG. 8 shows the expression of PVRIG, TIGIT, PD1 on CMVpp65 reactive T cells, as described in experiments of Example 1. (A) Gating strategy for detection of tetramer-stained CMV-CTLs. The gating hierarchy and tetramer positive cells in three donors are shown. The lymphocytes were gated in the FS/SS quadrant (upper left) followed by the selection of singlets, followed by the removal of CD14− CD19−CD56− cells, followed by CD3+ CD8+ positive cells. Within the CD3+ CD8+ positive population, the percentage of cells that bind each tetramer is determined in individual donors. Staining results using the HLA-A*02:01 CMV tetramer are shown. (B) The expression of PVRIG, TIGIT and PD-1 on the CMVpp65 reactive T cells expanded from 3 donors is shown.

FIG. 9 shows the kinetics of PVRIG, TIGIT and PD-1 expression on CD8+CMV+ T cells, as described in experiments of Example 1. (A) Percent pp65 tetramer positive of CD8 T cells after 0, 72, 144, 216 and 288 hours of stimulation with IL-2, IL-7 and CMV pp65 peptide is shown. (B) TIGIT, (C) CHA.7.518.1.H4(S241P), (D) PD-1 expression on CMVpp65 reactive CD8 T-cells at distinct time points after stimulation. (n=3)

Figure 10:
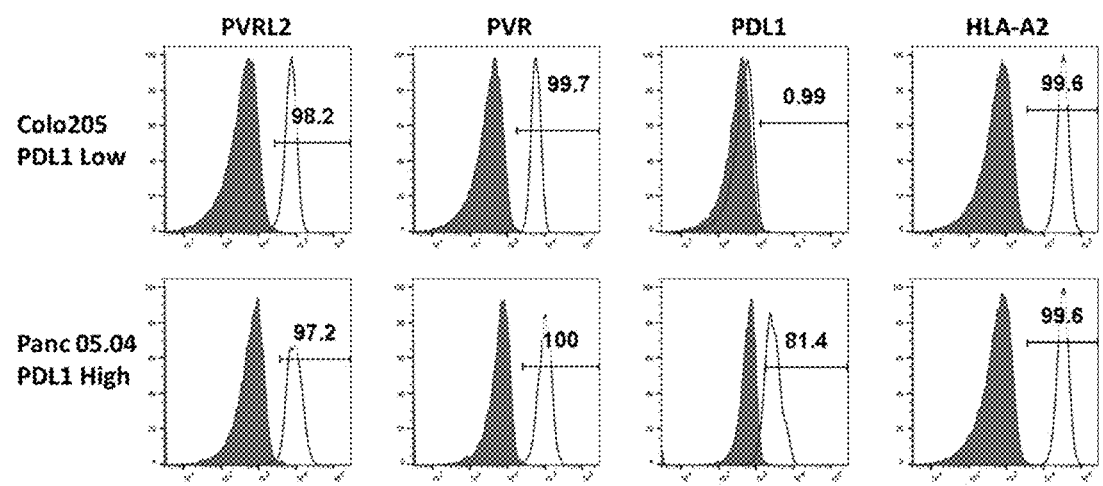
Figure 11A:
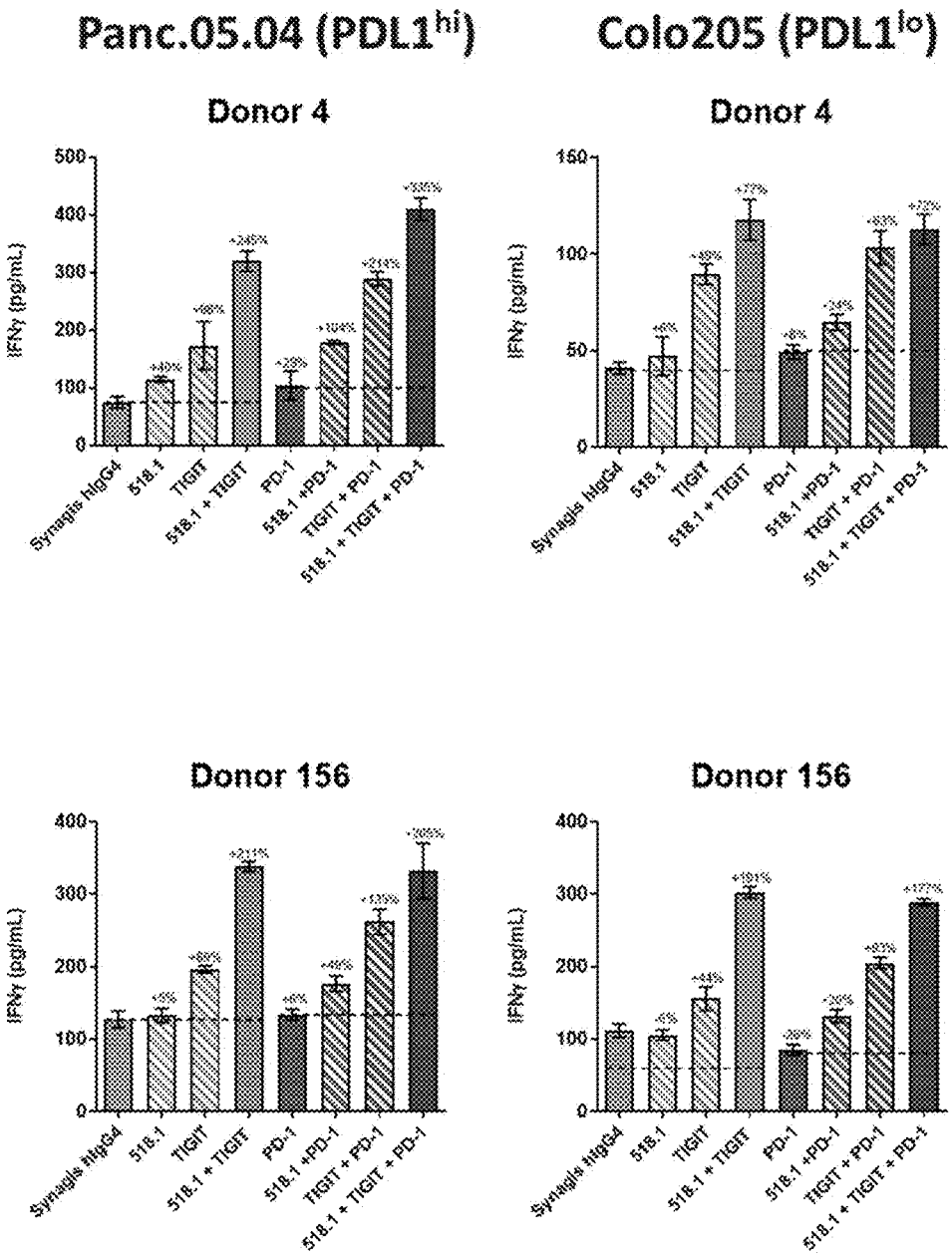
Figure 11B:
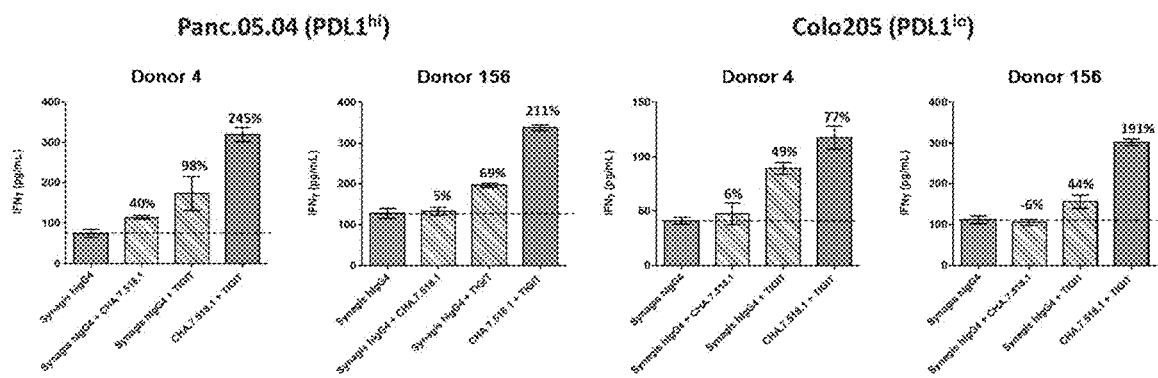
Figure 11C:
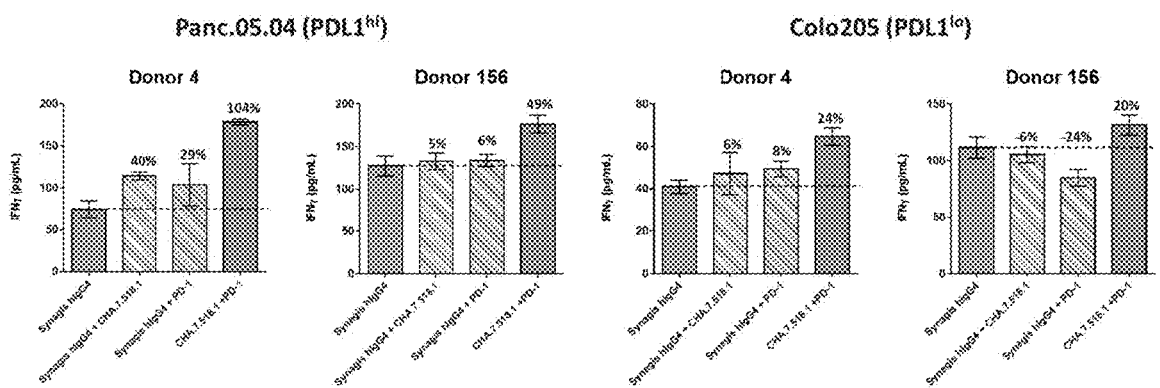
Figure 11D:
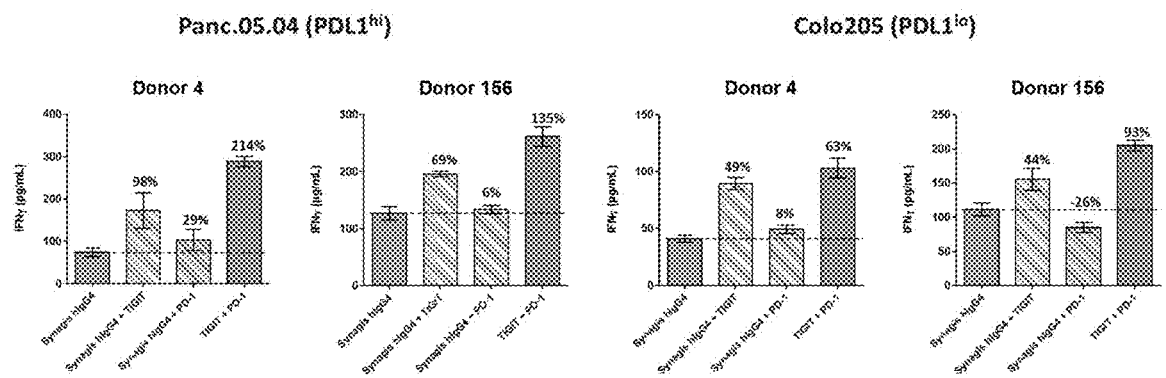

FIG. 10 shows the expression of PVRL2, PVR, PDL1 and HLA-A2 on the Colo205 and Panc.04.05 cells was evaluated by flow cytometry, as described in experiments of Example 1. The number in the upper right hand corner denotes the percentage of the ligand (PVRL2, PVR, PDL1) or HLA-A2 expressed on the tumor cell lines in comparison to the isotype control antibody.

FIG. 11A-11D shows the effect of inhibitory receptor blockade on CMVpp65 reactive CD8 T cells in co-culture with cancer cell lines, as described in experiments of Example 1. CMVpp65 reactive T cells for 2 donors (Donor 4 and Donor 156 were co-cultured with 0.03 ug/ml CMVpp65 peptide loaded Panc.04.05 or Colo205 for 24 hr in the presence of 10 ug/ml CHA.7.518.1.H4(S241P), anti-TIGIT, anti-PD-1, or isotype control either alone or in combination. (A) CHA.7.518.1.H4(S241P), anti-TIGIT or anti-PD1 antibodies tested alone, in dual combination, or in triple combination. (B) CHA.7.518.1.H4(S241P) and anti-TIGIT antibodies tested alone or in combination. (C) CHA.7.518.1.H4(S241P) and anti-PD1 antibodies tested alone or in combination. (D) Anti-TIGIT and anti-PD1 antibodies tested alone or in combination. Conditioned media were assayed for cytokine secretion. The bar graphs show the average+standard deviation for IFN-γ, with each dot representing a technical replicate. Data are representative of n>2 experiments.

Figure 12:
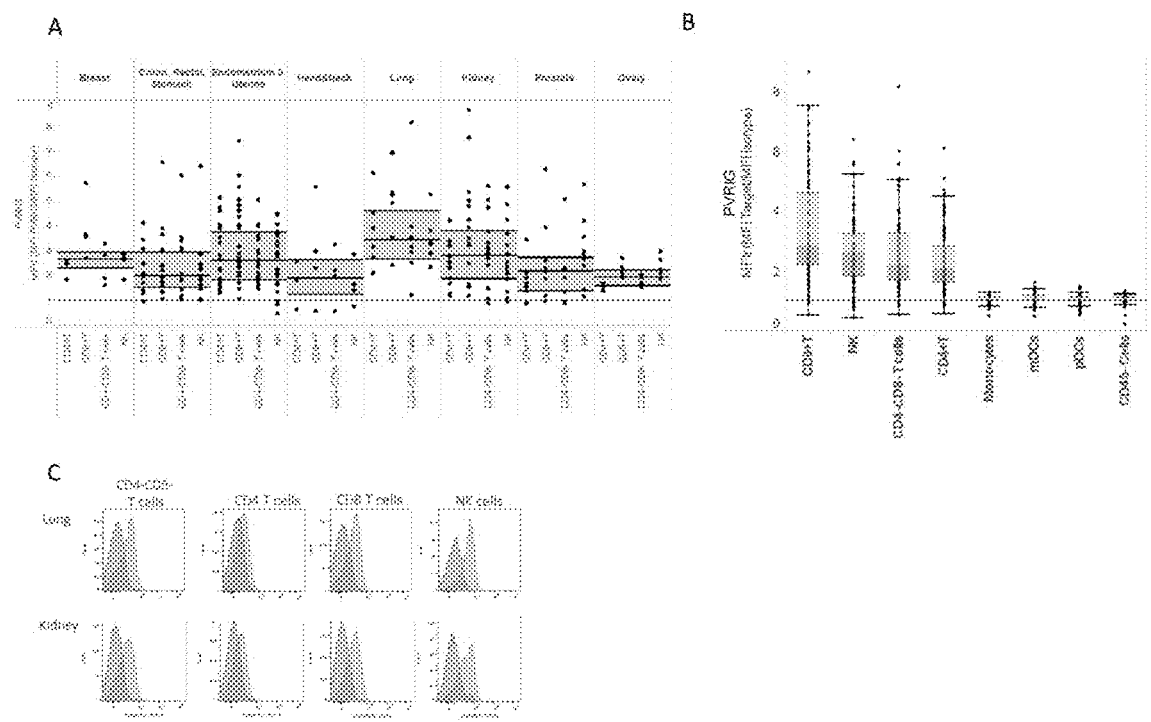

FIG. 12 shows the expression of PVRIG on cells from dissociated tumors, as described in experiments of Example 2. (A) Samples were grouped based on the tumor type as defined by the pathology report. For each sample, expression of PVRIG is shown on CD4+ T cells, CD8+ T cells, CD4−CD8− T cells, and on NK cells. Each dot within a column represents an individual sample. Samples with a MFIr value above 1 denotes expression of PVRIG was detected. The median is depicted by the middle line and the upper and lower quartiles are depicted by the grey space above and below the median line. (B) Across all tumor samples examined, the expression of PVRIG on CD4+ T cells, CD8+ T cells, CD4−CD8− T cells, and on NK cells is shown. The median is depicted by the middle line and the upper and lower quartiles are depicted by the light and dark grey space above and below the median line. The whiskers depict 1.5 times the interquartile range. (C) Representative FACS histograms for PVRIG (blue) compared to isotype control (red) are shown for 4 cell subsets isolated from a lung and kidney tumor.

Figure 13:
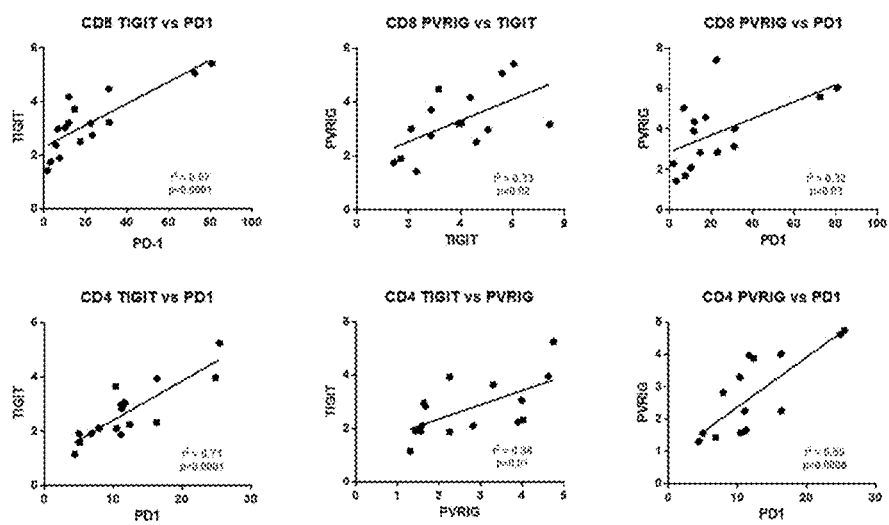

FIG. 13 shows the correlation analysis of PD1, TIGIT, and PVRIG expression on CD4+ and CD8+ T cells from dissociated endometrial tumors, as described in experiments of Example 2. For each endometrial sample, a MFIr was calculated for PVRIG, PD1, and TIGIT on CD4 and CD8 T cells. A Spearman's correlation analysis was performed and a r2 and p value reported.

Figure 14:
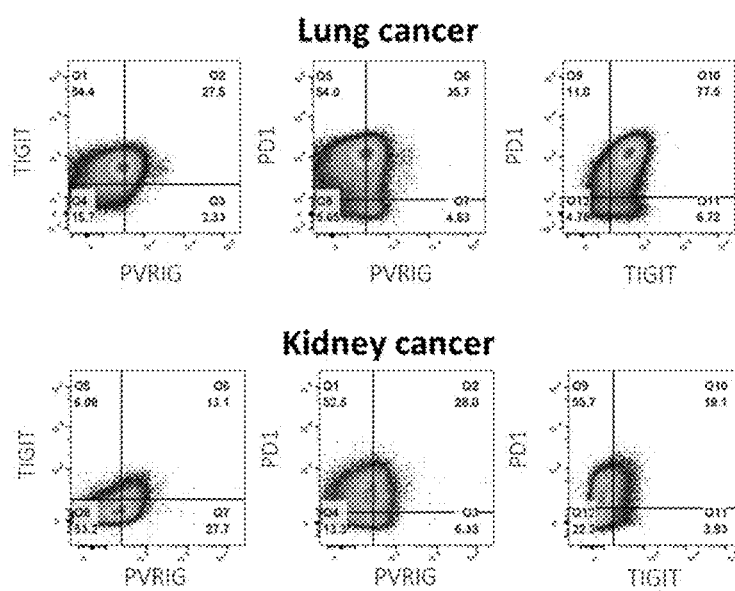

FIG. 14 shows the co-expression analysis of PD1, TIGIT, and PVRIG expression on CD8+ T cells from a dissociated lung and kidney cancer sample, as described in experiments of Example 2.

Figure 15:
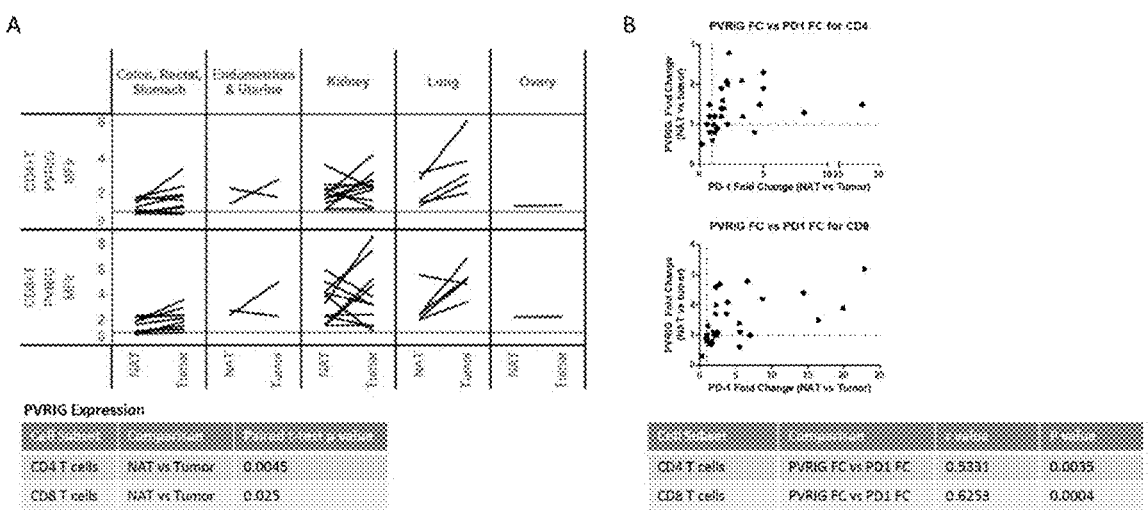

FIG. 15 shows a comparison of PVRIG expression on T cells from dissociated tumors with matched NAT, as described in experiments of Example 2. (A) Matched tumor and normal adjacent tissues from colon/stomach/rectal, endometrium/uterine, kidney, lung, and ovarian tumors were assessed for PVRIG expression on CD4 and CD8 T cells. Each line represents a matched donor. A paired Student's t-test was performed on all samples comparing NAT vs tumor expression of PVRIG on CD4 and CD8 T cells. (B) PVRIG fold change (in NAT vs tumor) is plotted vs PD1 fold change for CD4 and CD8 T cells. A spearman's correlation analysis was done and r value and p value is shown.

Figure 16:
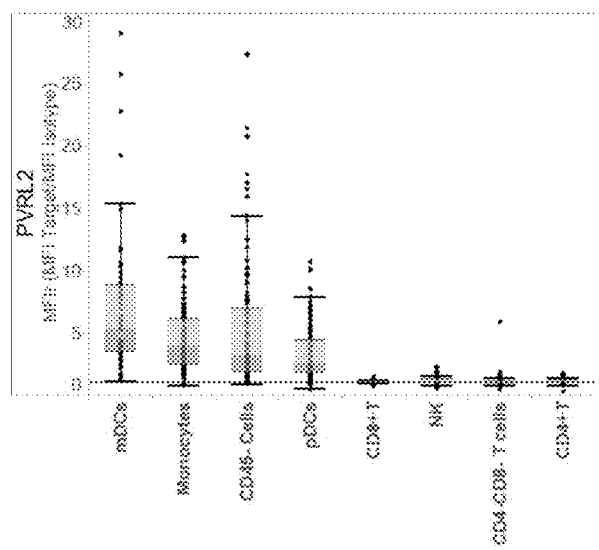

FIG. 16 shows the expression of PVRL2 on immune and non-immune subsets from all dissociated tumor samples, as described in experiments of Example 2. The expression of PVRL2 on various cell subsets derived from tumors is shown. MFIr values above 1 denote expression of PVRL2 was detected. The median is depicted by the middle line and the upper and lower quartiles are depicted by the light and dark grey space above and below the median line. The whiskers depict 1.5 times the interquartile range.

Figure 17:
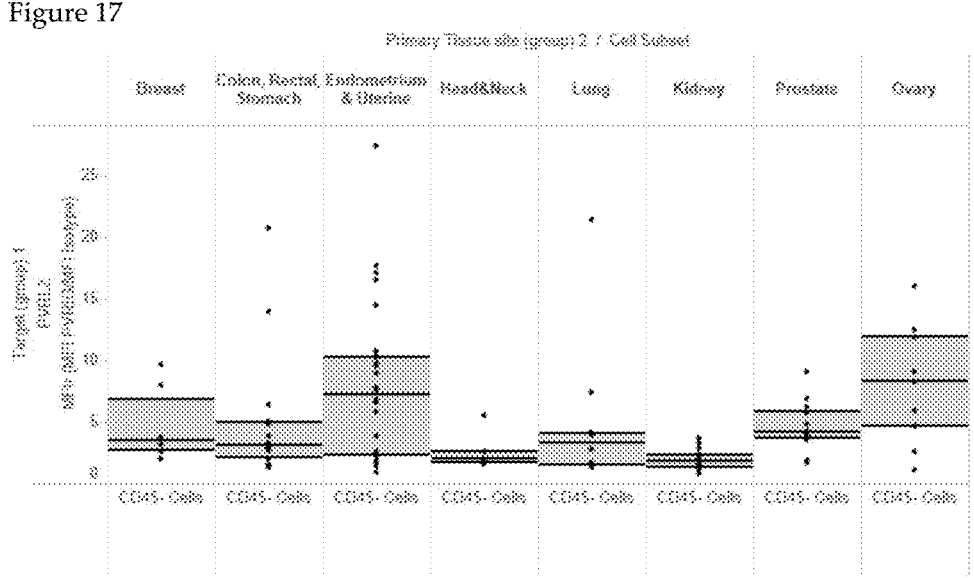

FIG. 17 shows the expression of PVRL2 on non-immune subsets from dissociated tumors, as described in experiments of Example 2. Samples were grouped based on the tumor type as defined by the pathology report. For each sample, expression of PVRL2 is shown on CD45− non-immune cells. Each dot represents an individual sample. The median is depicted by the middle line and the upper and lower quartiles are depicted by the grey space above and below the median line.

Figure 18:
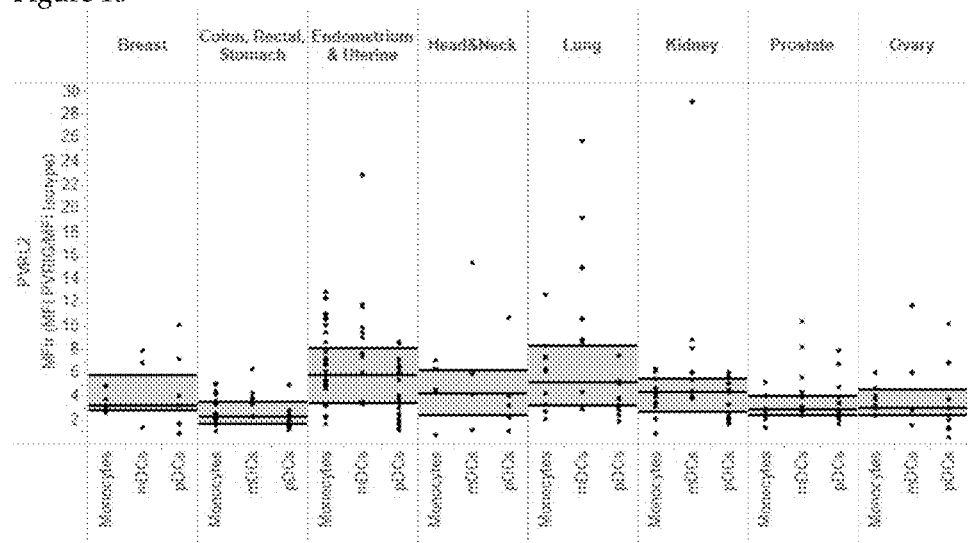

FIG. 18 shows the expression of PVRL2 on myeloid cell subsets from dissociated tumors, as described in experiments of Example 2. Samples were grouped based on the tumor type as defined by the pathology report. For each sample, expression of PVRL2 is shown on myeloid cells which include monocytes, mDC, and pDC populations. Each dot represents an individual sample. The median is depicted by the middle line and the upper and lower quartiles are depicted by the grey space above and below the median line.

Figure 19:
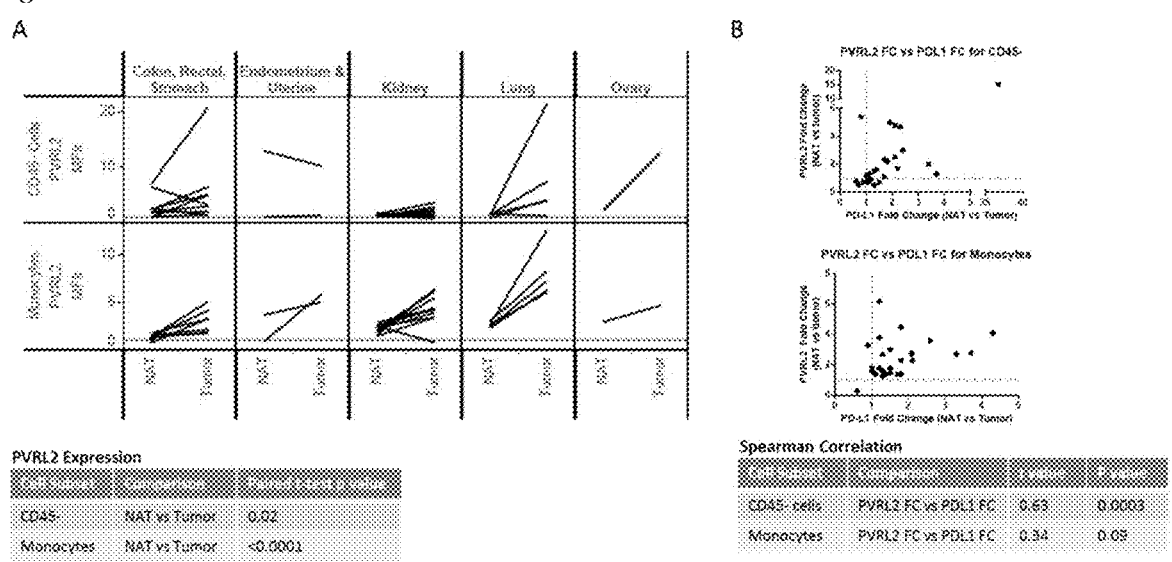

FIG. 19 shows a comparison of PVRL2 expression on monocytes and CD45-tumor cells from dissociated tumors and matched NAT, as described in experiments of Example 2. (A) Matched tumor and normal adjacent tissues from colon/stomach/rectal, endometrium/uterine, kidney, lung, and ovarian tumors were assessed for PVRL2 expression on CD45− cells and on monocytes. Each line represents a matched donor. A paired Student's t-test was performed on all samples comparing NAT vs tumor expression of PVRL2 on CD45− cells and on monocytes cells. (B) PVRL2 fold change (in NAT vs tumor) is plotted vs PD-L1 fold change for CD45− cells and for monocytes. A spearman's correlation analysis was done and r value and p value is shown.

Figure 20:
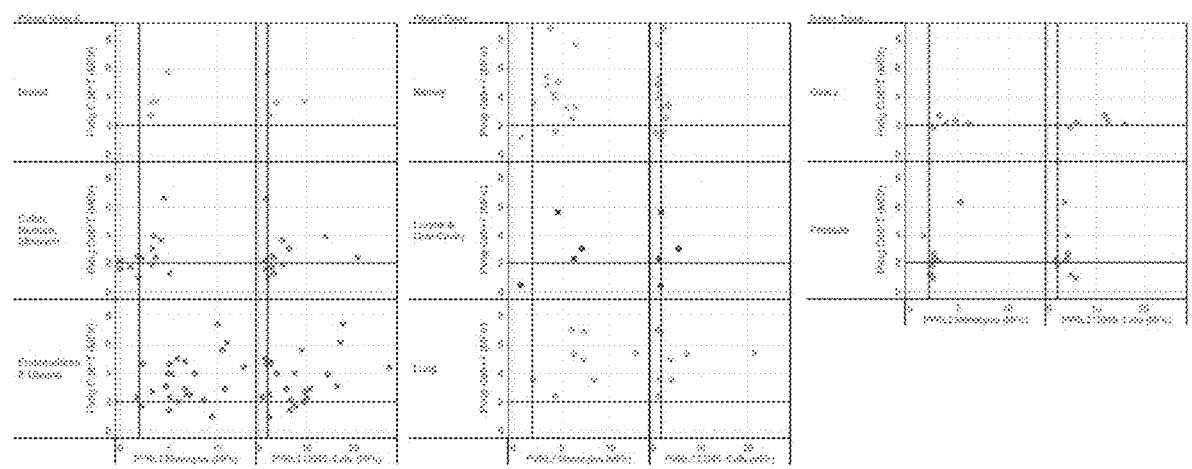

FIG. 20 depicts the co-expression of PVRIG on T cells with PVRL2 on monocytes and CD45− cells in tumor tissues, as described in experiments of Example 2. From the same sample, the expression of PVRIG on CD8 T cells and PVRL2 on monocytes or CD45− cells was plotted. Tumor types were grouped and each dot represents an individual tumor. Reference lines were drawn at MFIr value of 2.

Figure 21A:
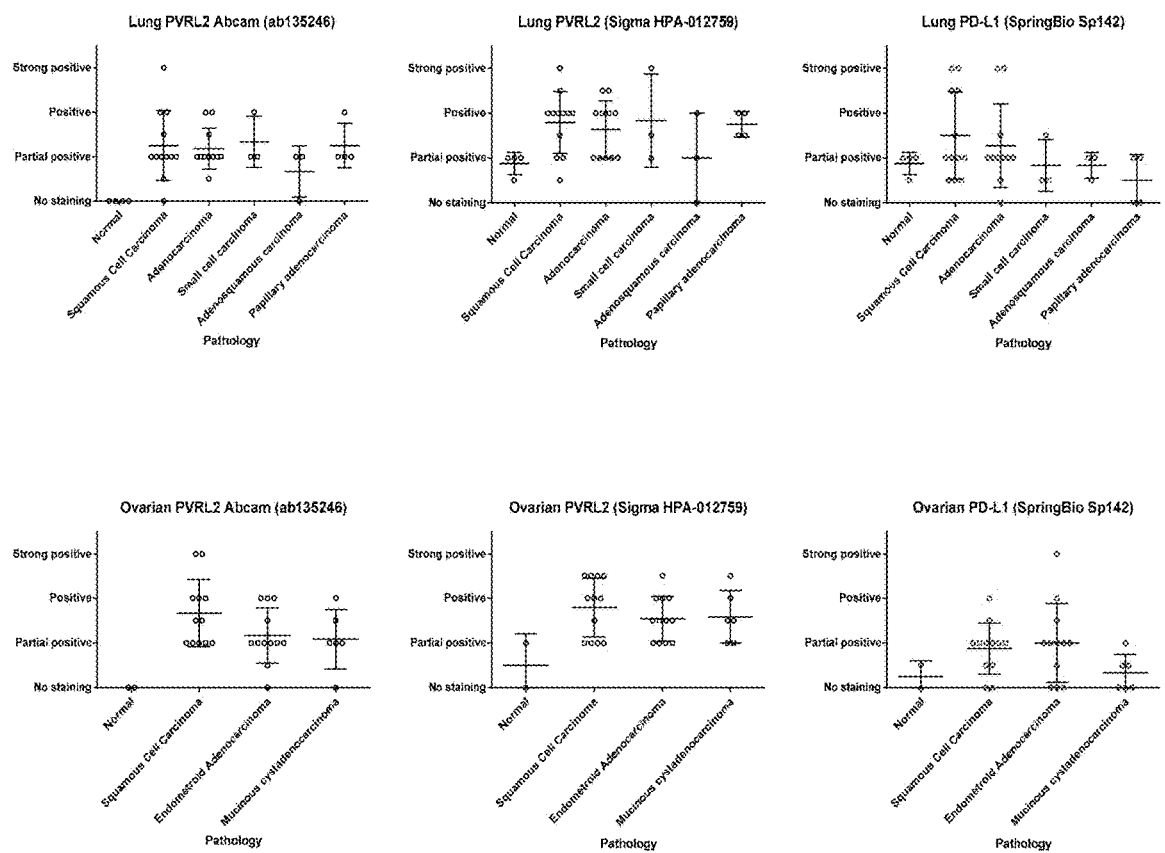
Figure 21B:
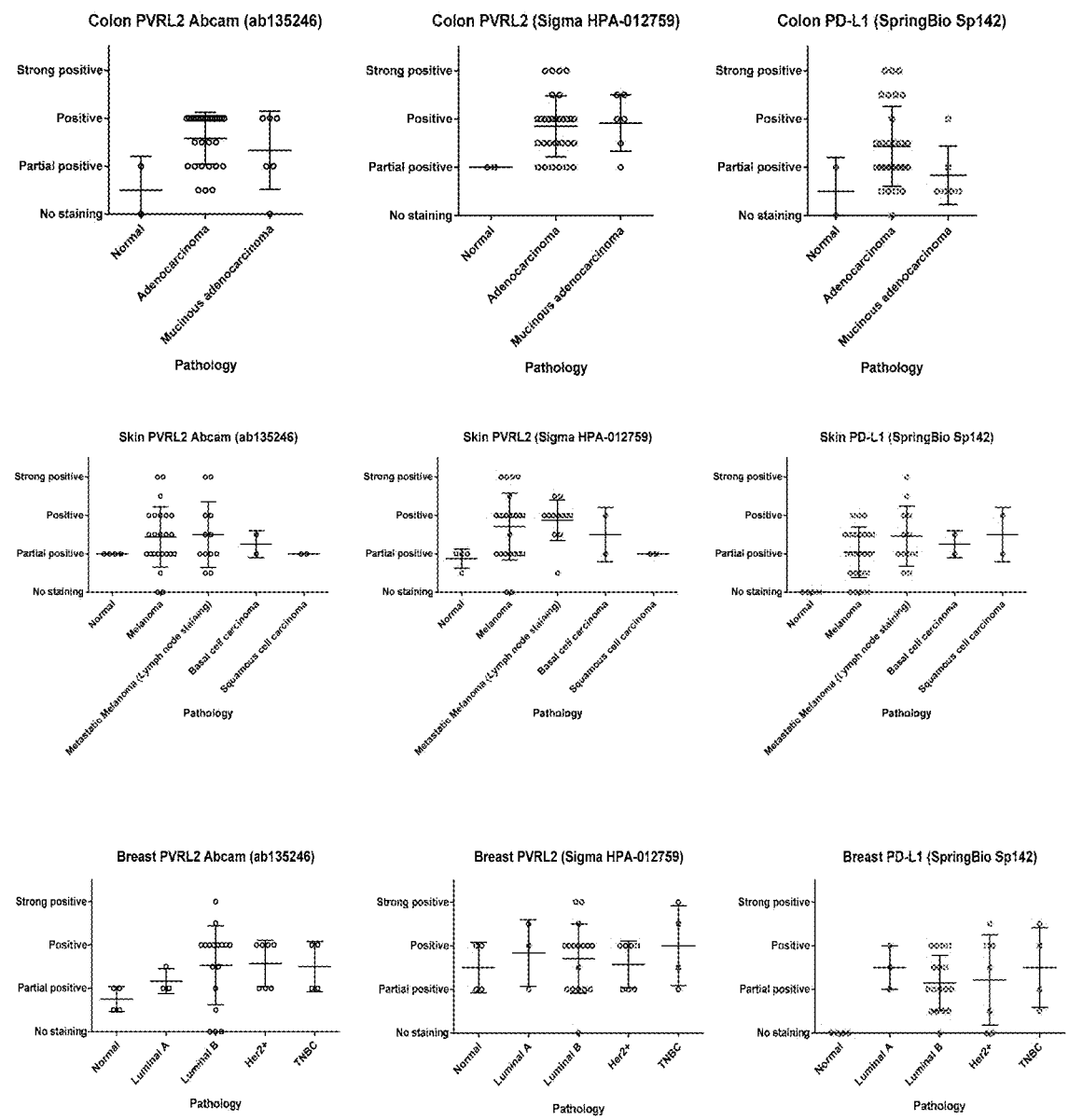

FIG. 21A-21B depicts the expression of PVRL2 and PD-L1 in colon, skin, and breast cancers, as described in experiments of Example 3.

Figure 22:
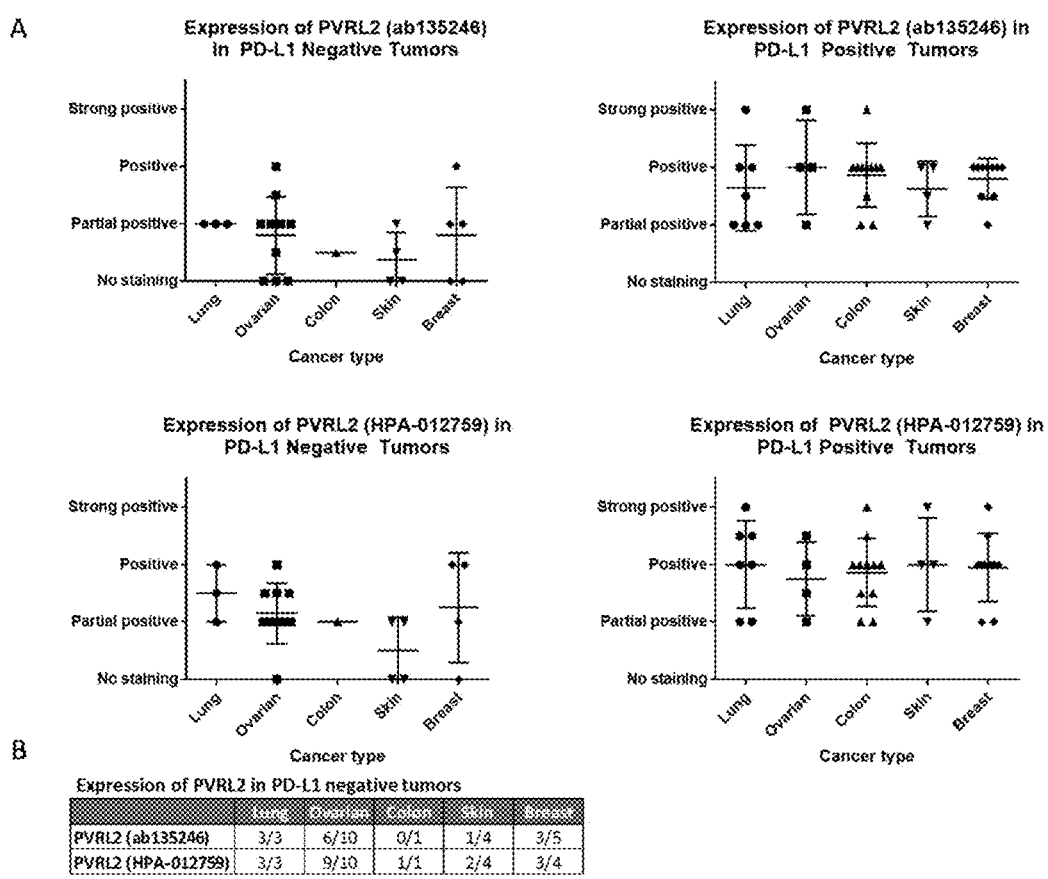

FIG. 22 depicts the expression of PVRL2 in PD-L1 negative and PD-L1 positive tumors, as described in experiments of Example 3. Based on PD-L1 staining, tumors were categorized as PD-L1 Negative (No staining of PD-L1 observed in either duplicate cores for each tumor) or PD-L1 Positive (Positive staining observed in both duplicate cores for each tumor. A) Expression of PVRL2 was analyzed and shown for each cancer type. B) Of the PD-L1 negative tumors, the number of PVRL2 expressing samples (PVRL2 partial positive or greater/total samples) for each cancer type is shown.

FIG. 23 shows the expression of PVRL2 and PD-L1 at the invasive front of the tumor, as described in experiments of Example 3. A. In this tumor sample, PVRL2 was expressed on both immune cells and tumor cells at the invasive front, as delineated by the blue and red lines. B) In this tumor sample, PD-L1 was expressed in the immune compartment.

Figure 24:
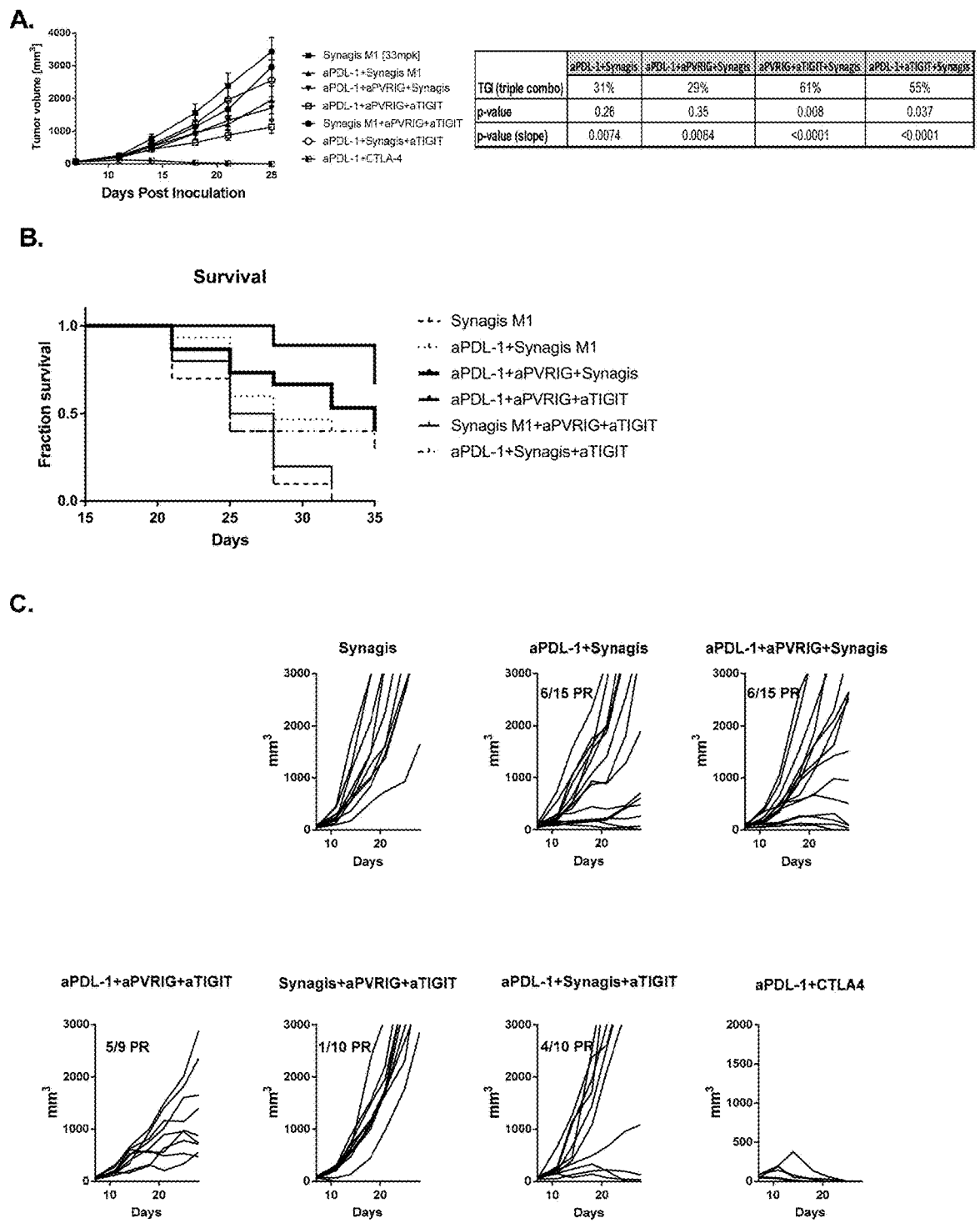

FIG. 24 shows antitumor responses of mono, dual and triple combination antibody treatments in the CT26 tumor model, as described in experiments of Example 4. Groups of 10-15 Balb/c mice were subcutaneously injected with $5 \times 10^5$ CT26 cells. Mice were treated x2 weekly for 3 weeks, starting at day 7 post inoculation with the designated antibody combination. A) Tumor volumes of all tested groups were measured x2 weekly, including positive control group (anti-PDL-1+anti-CTLA-4 antibodies). The TGIs and p-values of the triple combination group compared to the indicated groups summarized in the table. B) Survival proportions of assigned groups. C) Spider plots showing individuals response over treatment groups, while PR indicates partial responders with tumor size not exceeding 1000 $mm^3$.

Figure 25:
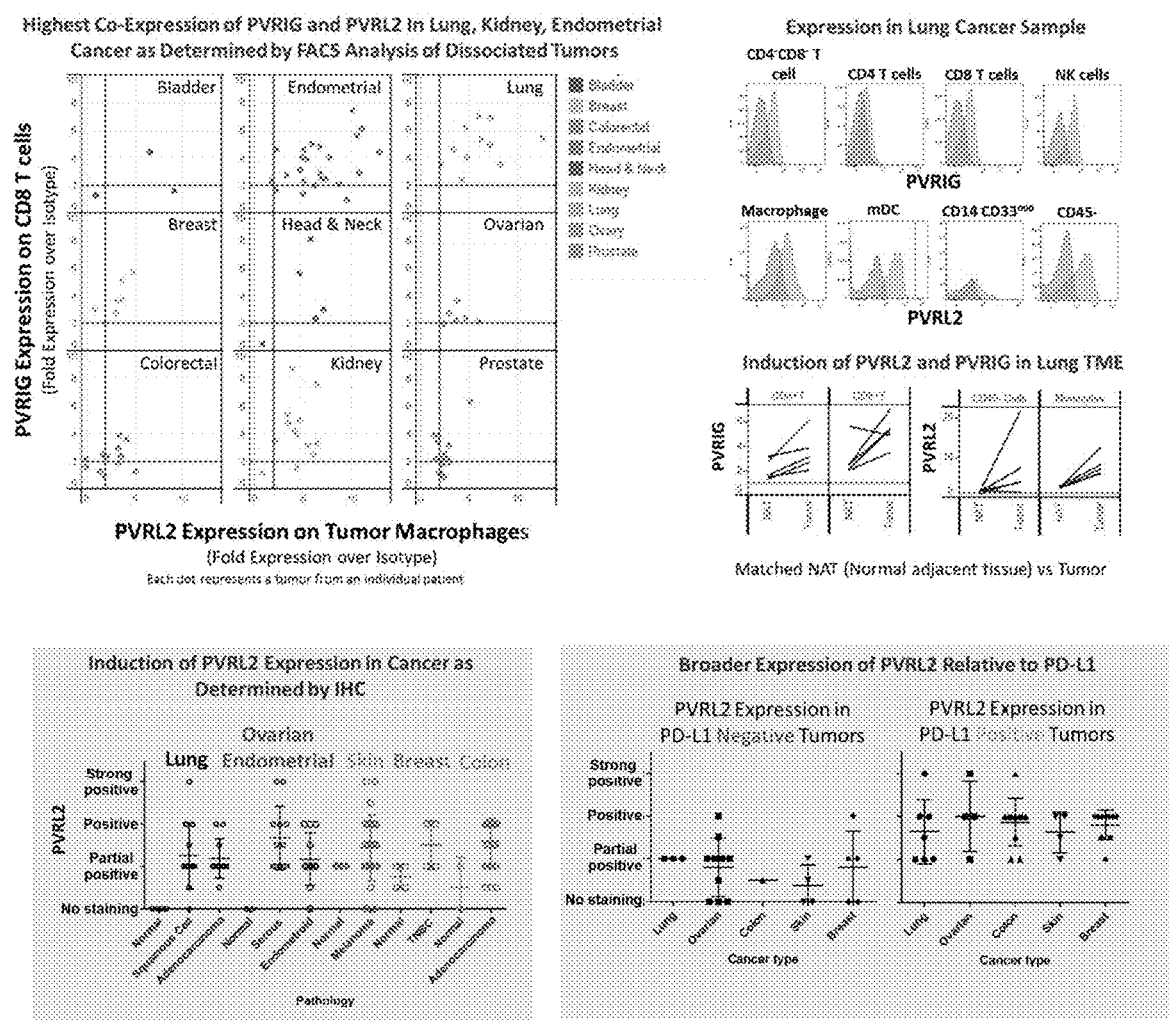

FIG. 25 depicts expression profiles for PVRIG and PVRL2, as well as PD-L1 in various human tumors, as described in experiments of Examples 2 and 3.

FIG. 26 depicts in vivo data regarding the use of an anti-PVRIG antibody in TIGIT−/− mice or the combination of anti-PVRIG and anti-PD-1 antibodies in wild type Balb/c mice to reduce syngeneic tumor growth, as described in experiments of Example 4.

Figure 27:
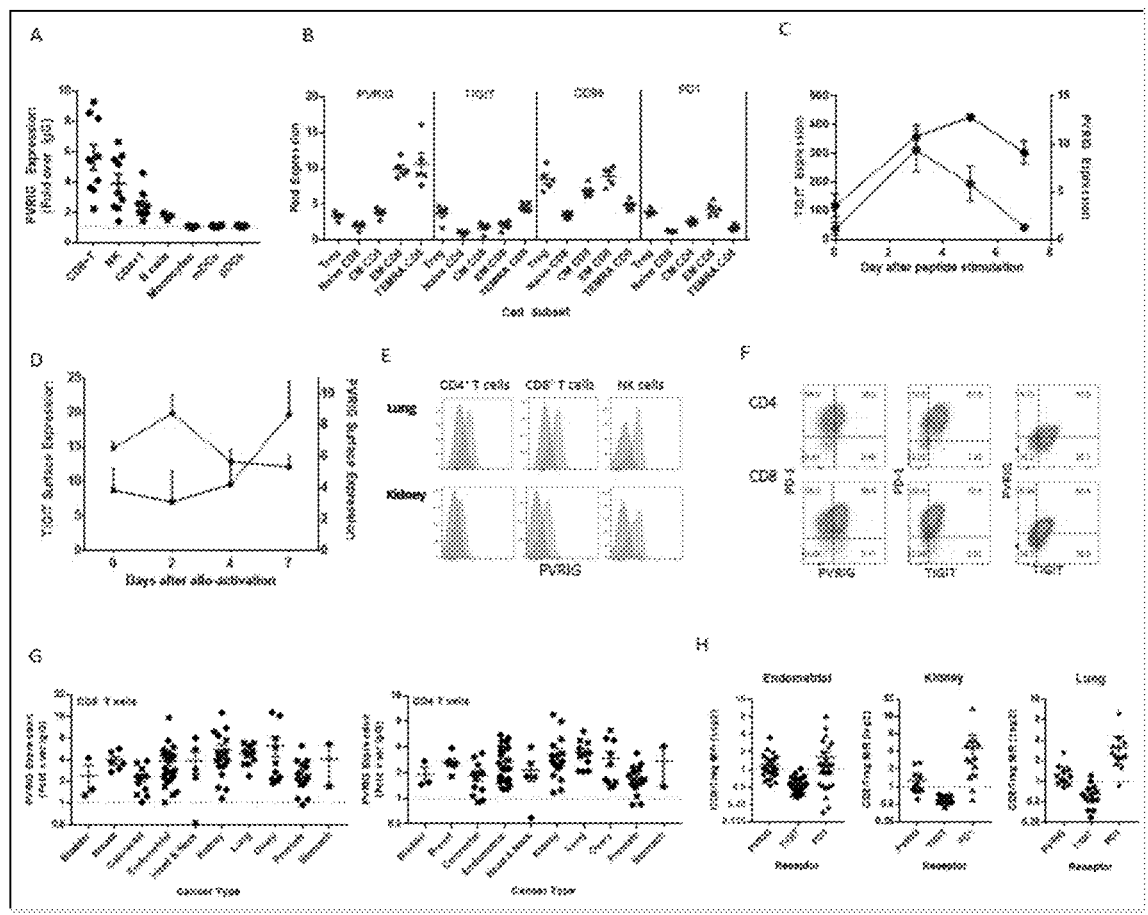

FIG. 27. PVRIG is expressed highest on cytotoxic lymphocyte subsets from human cancer. A) Expression of PVRIG on leukocyte cell subsets from 5-8 healthy donor PBMCs is shown. PVRIG expression is defined as the ratio of PVRIG MFI relative to isotype control MFI. B) Expression of PVRIG, TIGIT, CD96, and PD-1 on peripheral blood Tregs as compared to CD8 T cell subsets from 5 healthy donor PBMCs is shown. C) CMV pp65 specific T cells from 3 healthy donors were expanded in vitro with pp65 (495-503) peptide, IL-2 and IL-7 for up to 7 days. Expression of TIGIT (blue) and PVRIG (black) on HLA-A2/pp65 (495-503) tetramer positive cells is shown. D) Human T cells were cultured with allogeneic DCs and expression of TIGIT and PVRIG shown on $CD4^+$ T cells on day 0, 1, 2, and 7 post activation. E) Representative FACS plots showing expression of PVRIG (blue) compared to isotype control (red) on TILS (CD4 T cells, CD8 T cells, and NK cells) from a representative lung and kidney cancer. F) Co-expression of PVRIG, TIGIT, and PD-1 on CD4 and CD8 TILS from a lung cancer sample is shown. G) Expression of PVRIG on $CD8^+$ and $CD4^+$ TILS from dissociated human tumors of various cancer types is shown. Each dot represents a distinct tumor from an individual patient. H) Relative expression on CD8 TILs vs Treg TILS for PVRIG, TIGIT, and PD-1 from endometrial, kidney, and lung tumors was assessed. For each tumor, the fold expression on CD8 TILS was normalized to fold expression on Treg TILS and plotted. For A, B, C, G, and H, mean±SEM is shown by the error bars.

FIG. 28A-FIG. 28F. PVRL2 expression is enhanced in the tumor microenvironment. A) PVRL2 expression was assessed by IHC on lung, ovarian/endometrial, breast, colon, and kidney tumors. For each tumor, 2 cores were assessed by 2 independent observers. Representative staining for each descriptor is shown in Figure B) A representative melanoma tumor showing PVRL2 expression on tumor cells and in the immune cells in the stroma is shown. C) PVRL2 expression from dissociated tumors was examined by FACS on $CD45^−$, $CD14^+$ TAMs, and $CD14$-$CD33^{hi}$ mDC cell subsets. Mean±SEM is shown for each cancer type. D) Representative FACS plots for PVRL2 expression (blue) as compared to IgG (red) are shown for a lung cancer. E) For tumor samples where we were able to assess both PVRIG and PVRL2 expression, PVRIG expression on CD8 T cells is plotted versus PVRL2 expression on $CD14^+$ TAMS for each tumor. Each dot represents an individual tumor sample. Red line represents a 2 fold expression of PVRIG or PVRL2 compared to IgG.

Figure 29:
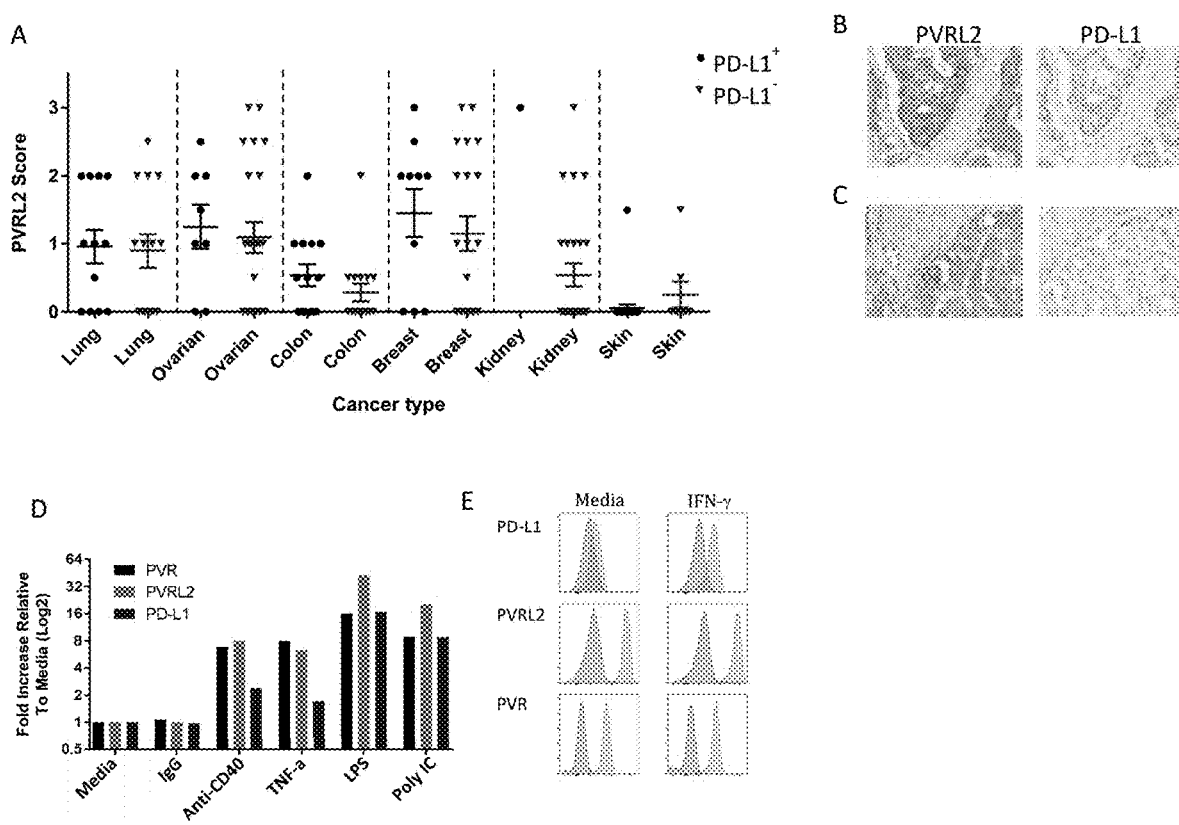

FIG. 29. Distinct regulation of PVRL2 and PD-L1 on tumor cells. A) Expression of PD-L1 and PVRL2 was assessed by IHC on serial sections. Expression of PVRL2 on PD-L1 negative (left) and PD-L1 positive (tumors) is shown. PD-L1 negative tumors were defined as no staining observed on duplicate cores for a given tumor. PD-L1 positive staining was defined as at least partial positive on both duplicate cores of a give tumor. The number of PVRL2 positive tumors from PD-L1 positive and PD-L1 negative tumors is shown in the table (positive/total). B, C) Representative expression of a PVRL2+PD-L1− endometrial (B) tumor and a PVRL2+PD-L1− lung (C) tumor. D) Immature BM-DCs were cultured with the indicated stimuli and PVR, PVRL2, PD-L1 expression assessed by FACS on day 2 of culture. For each condition, expression was normalized to media only control condition. E) Expression of PVR, PVRL2, and PD-L1 on HT-29 cells treated with IFN-γ or media alone is shown. PD-L1 or PVRL2 is shown in blue and IgG isotype control staining is shown in red.

Figure 30:
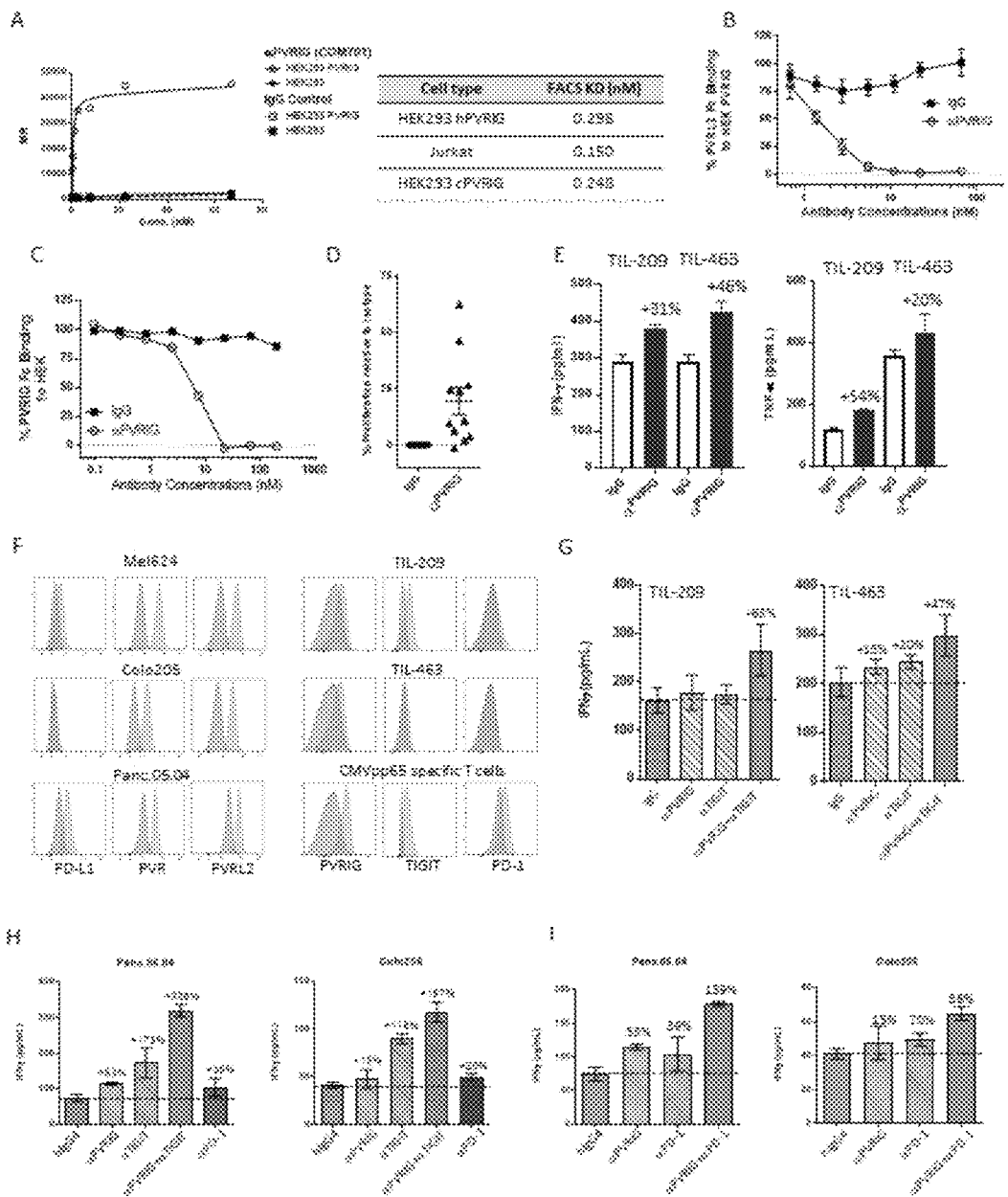

FIG. 30. CHA.7.518.1.H4(S241P) is a high affinity antibody that enhances T cell activation. A) Binding of CHA.7.518.1.H4(S241P) or IgG isotype control to HEK293 PVRIG or HEK293 parental cells by FACS is shown. FACS KD values are shown for the binding of CHA.7.518.1.H4 (S241P) to HEK293 hPVRIG, HEK293 cPVRIG, and Jurkat cells. B) CHA.7.518.1.H4(S241P) disrupts the binding of PVRL2 Fc to HEK293 cells ectopically expressing PVRIG. Mean±Std Dev of triplicate values is shown. C) CHA.7.518.1.H4(S241P) blocks the binding of PVRIG Fc to HEK293 cells that endogenously express PVRL2. D) Human CD4 T cells were co-cultured with aAPC CHO cells expressing a cell surface bound anti-CD3 antibody and hPVRL2 in the presence of 10 μg/ml anti-PVRIG antibody and human IgG isotype control antibodies. The effect of anti-PVRIG Ab on proliferation of CD4 T cells isolated from 11 different donors is shown. Bars depicted mean±SEM. E) gp100 specific T cell lines (TIL-209, TIL-463) were co-cultured with CHO cells engineered to express HLA-A2 and PVRL2 along with 10 μg/ml anti-PVRIG or IgG isotype control antibody. IFN-γ and TNF-α production was tested at 24 hours post co-culture. Mean±Std Dev of triplicate values is shown. Percent change in IFN-γ and TNF-α for each condition relative to isotype control is depicted by the number above each bar. F) Expression of PVR, PVRL2, and PD-L1 (red) relative to IgG (blue) on MEL624, Colo205, and Panc.05.04 cells is shown. For the T cells, expression of PVRIG, TIGIT, and PD-1 (red) relative to IgG (blue) on TIL-209 and TIL-463 gp100 specific T cells, and on CMVpp65 specific T cells is shown. To expand CMVpp65 reactive T cells, PBMCs were cultured with pp65 (495-503) peptide, IL-2, and IL-7 for 10 days. Expression of PVRIG, TIGIT, PD-1 is shown on HLA-A2/pp65 tetramer positive cells. G) gp100 specific T cells (TIL-209, TIL-463) expanded from TILS derived from melanoma tumors were co-cultured with MEL624 cells in the presence of 10 μg/ml of the indicated antibodies. IFN-γ concentration in the conditioned media was determined at 24 hrs. H, I) Expanded CMVpp65 specific T cells were co-cultured with Colo205 and Panc.05.04 cells, CMVpp65 peptide, and the indicated antibodies at 10 μg/ml. IFN-γ concentration in the conditioned media was determined at 24 hrs. For E, G, H, I, average±Std Dev of triplicates is shown. Percent change in IFN-γ for each condition relative to isotype control is depicted by the number above each bar.

Figure 31:
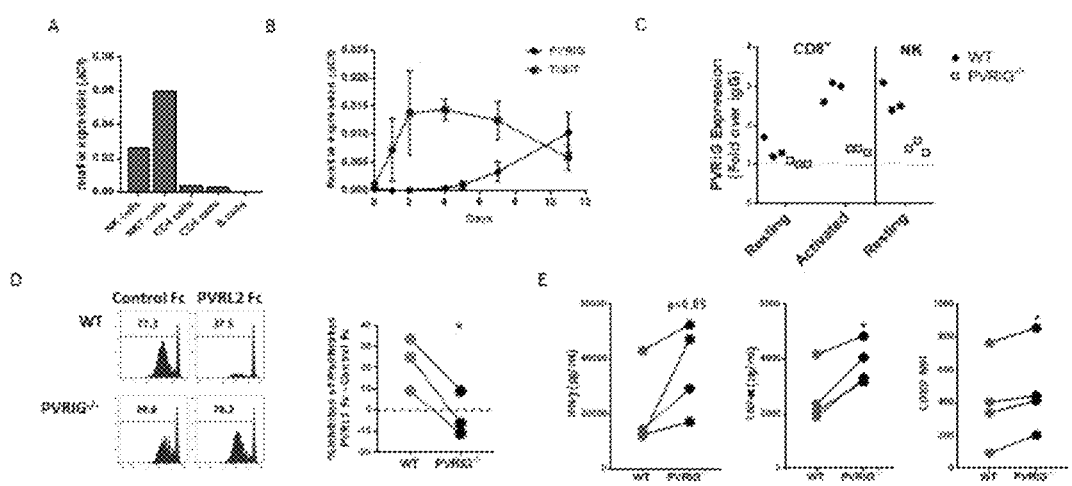

FIG. 31. PVRIG deficient mice have increased T cell function. A) RNA expression of PVRIG as measured by qRT-PCR from purified mouse immune cell subsets was assessed. Relative expression to housekeeping was determined by ΔCt method. B) pmel $CD8^+$ TCR transgenic T cells were activated with gp100 (25-33) and PVRIG and TIGIT RNA transcript levels assessed by qRT-PCR at the indicated time points. Graph shows mean±SEM of results from 5 different experiments. C) Spleens were harvested from $PVRIG^{−/−}$ and WT littermates and analyzed by flow cytometry for expression of PVRIG on NK, $CD4^+$ and $CD8^+$ T cells ("Resting" cells). In addition, $CD3^+$ T cells were isolated from splenocytes and activated for 11 days with anti-CD3/anti-CD28 beads. Following the activation, PVRIG expression on $CD4^+$ and $CD8^+$ T cells ("activated" cells) was analyzed by flow cytometry. Each dot represents cells derived from an individual mouse. D) WT and $PVRIG^{−/−}$ derived splenocytes were labeled with Cell Proliferation Dye eFluor450 and were cultured in the presence of Control-Fc (mouse IgG2a) or with mouse PVRL2 Fc. After 4 d of culture, cell division was analyzed by flow cytometry. Representative FACS plots from an experiment (left) and the summary of percentage inhibition by PVRL2 Fc (defined as % proliferation Control-Fc subtracted from % proliferation PVRL2 Fc) 3 independent experiments (right) are presented. * indicate p-value<0.05, paired student's t-test for the change in proliferation in the presence of PVRL2-FC relative to proliferation in the presence of protein control in WT versus PVRIG$^{-/-}$ T cells E) pmel CD8+ T cells derived from pmel PVRIG$^{-/-}$ or pmel PVRIG WT mice were activated for 11 days with their cognate peptide and IL2. Activated pmel CD8$^+$ cells were then co-cultured with B16-Db/gp100 cells for 18 hours and following the co-culture were evaluated for CD107 expression and for cytokine production. Four independent experiments are presented as indicated by each paired dot. * indicate p-value<0.05, Student's t-test comparing PVRIG$^{-/-}$ versus WT.

Figure 32:
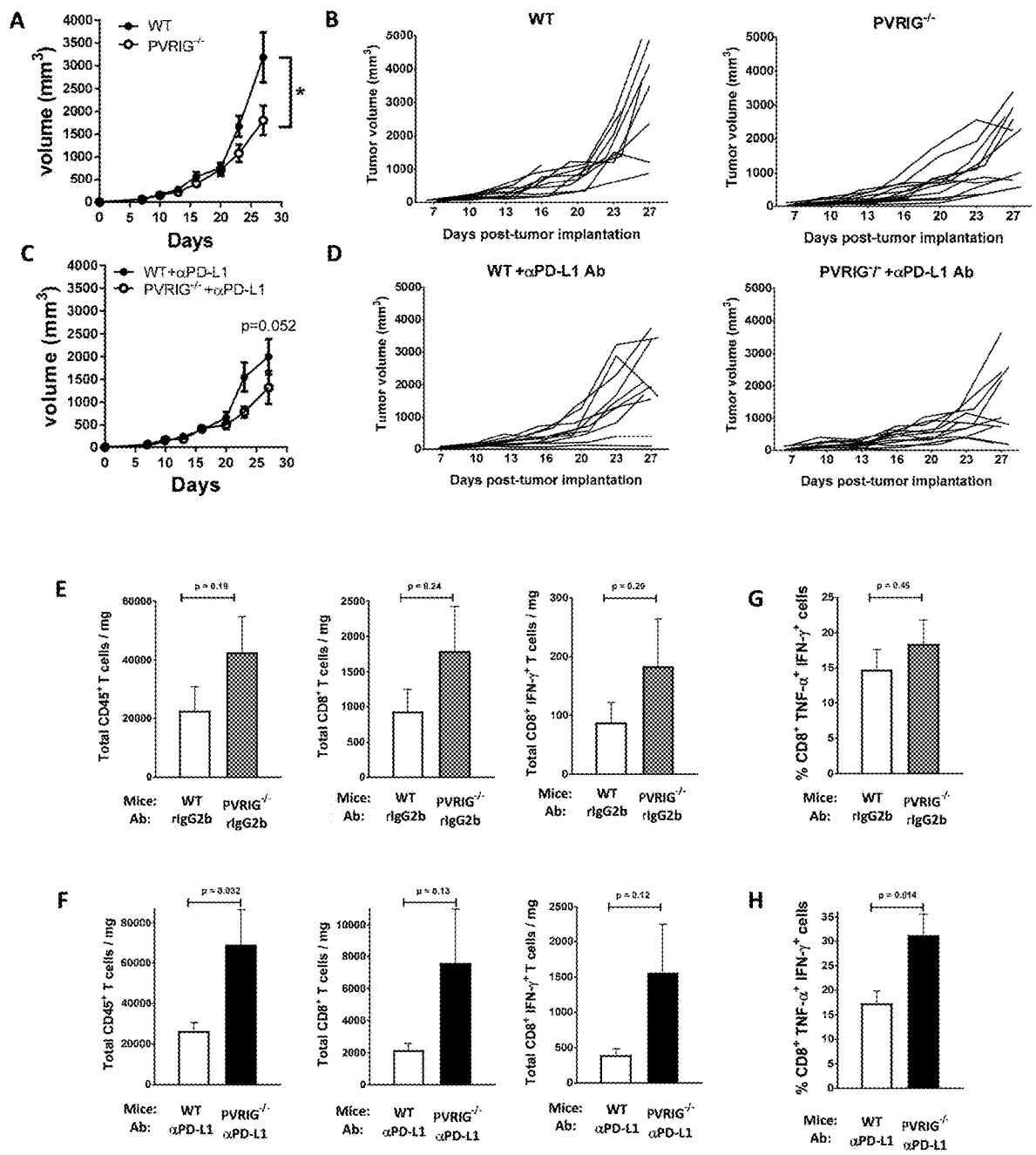

FIG. 32. PVRIG deficiency results in reduced tumor growth and increased CD8 effector T cell mechanism. (A) C57BL/6 WT or PVRIG$^{-/-}$ mice were subcutaneously injected with 5×10$^5$ MC38 cells. Tumor volumes were measured ×2 weekly. * indicate p-value<0.05 for WT mice versus PVRIG$^{-/-}$ mice (ANOVA). (B) Individual tumor growth curves are shown. One representative experiment out of 2 performed is shown. (C) C57BL/6 WT or PVRIG$^{-/-}$ mice were subcutaneously injected with 5×10$^5$ MC38 cells. At day 14 post-inoculation, mice were treated with anti-PD-L1, ×2 weekly for 2 weeks. Tumor volumes were measured ×2 weekly. p-value=0.052 for WT mice versus PVRIG$^{-/-}$ mice, both treated with anti-PD-L1. (D) Individual tumor growth curves are shown. One representative experiment out of 2 performed is shown. (E) Frequency of CD8$^+$ IFN-γ$^+$ TNF-α$^+$ effector cells in tumor-draining lymph nodes from 4 treatment groups on day 18 is shown. (F) Total number of CD8+ IFN-γ+TNF-α+ effector cells per mg tumor tissue on day 18 is shown. (G-H) Total TILS score and Cytotoxic T cells score relative to TILs, derived from nSolver 3.0 advanced analysis of the mouse pan-cancer immune codeset panel (Nanostring Technologies, Seattle, Wash.) run on CD45$^+$ enriched cells from MC38 day 18 TILs isolated from 2 treatment groups per wild-type and PVRIG deficient mice.

Figure 33:
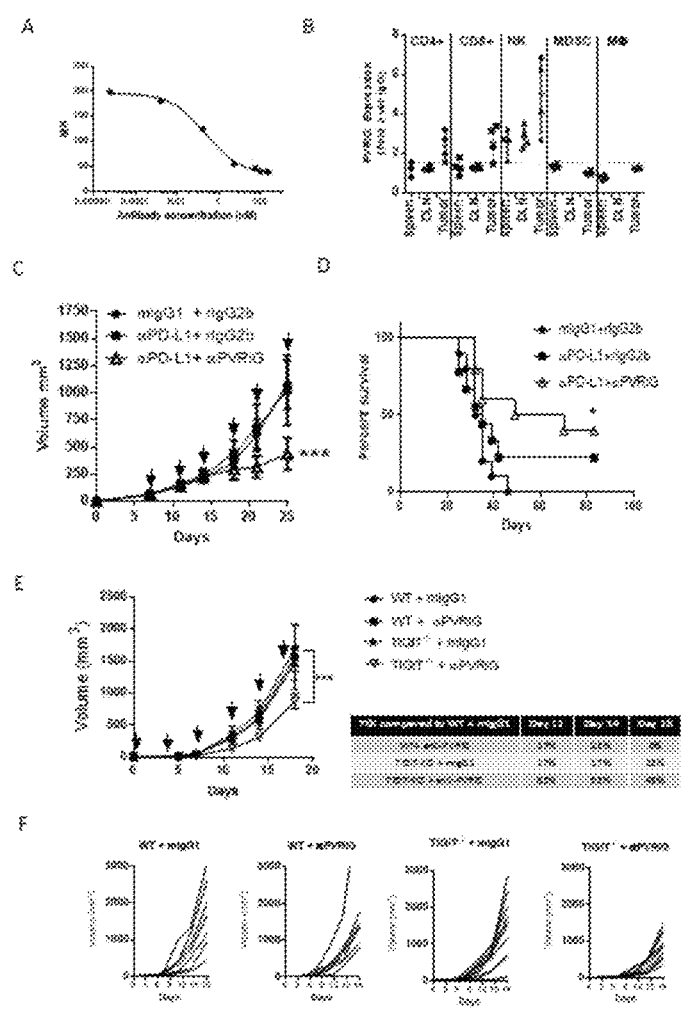

FIG. 33. Antagonistic anti-PVRIG antibodies synergistically inhibit tumor grown in combination of PD-1 inhibitors or TIGIT genetic deficiency. A) Binding of mPVRL2 Fc fusion protein to mPVRIG HEK293 engineered cells that were pre-incubated with serial dilutions of anti-mPVRIG mAb or IgG isotype control Ab is shown. B) BALB/c mice were subcutaneously injected with 5×10$^5$ CT26 cells. On day 14 post inoculation, mice were sacrificed and spleen, draining lymph nodes and tumors were harvested. Cells were analyzed by flow cytometry for expression of PVRIG on CD3+ CD4+ T cells, CD3+ CD8+ T cells, CD3-CD49b$^+$ NK cells, CD11b$^+$ Gr-1$^+$ Myeloid-Derived-Suppressor Cells (MDSC) and CD11b$^+$ F4/80$^+$ macrophages. C, D) BALB/c mice were subcutaneously injected with 5×10$^5$ CT26 cells. At day 7 post inoculation mice were treated with anti-PD-L1 and/or anti-PVRIG Ab, 2× weekly for 3 weeks (arrows indicate Ab treatment). C) Tumor volumes are shown. *** indicate p-value<0.001 (ANOVA) for anti-PD-L1+Rat IgG2b compared to anti-PD-L1+aPVRIG treated groups. Arrows indicate when antibodies were dosed. D. Survival analysis of complete responder's mice. * indicate p value<0.05 (Log-rank test) for anti-PD-L1+Rat IgG2b compared to anti-PD-L1+anti-PVRIG treated groups. One representative study of 3 studies are shown. E. C57BL/6 or TIGIT$^{-/-}$ mice were subcutaneously injected with 1×10$^5$ B16/Db-hmgp100 cells. Mice were treated 2× weekly for 3 weeks with the designated mAb starting on the day of inoculation (day 0). E. Tumor volumes were measured 2× weekly and average±SEM is shown. Tumor growth inhibition as measured at indicated days compared to control WT+mIgG1 isotype control. *** indicate p-value<0.001 for TIGIT$^{-/-}$+aPVRIG compared to WT+mIgG1 isotype control. Arrows indicate when antibodies were dosed. F. Individual tumor growth curves for each mouse is shown. One representative experiment out of 2 performed is shown.

Figure 34:
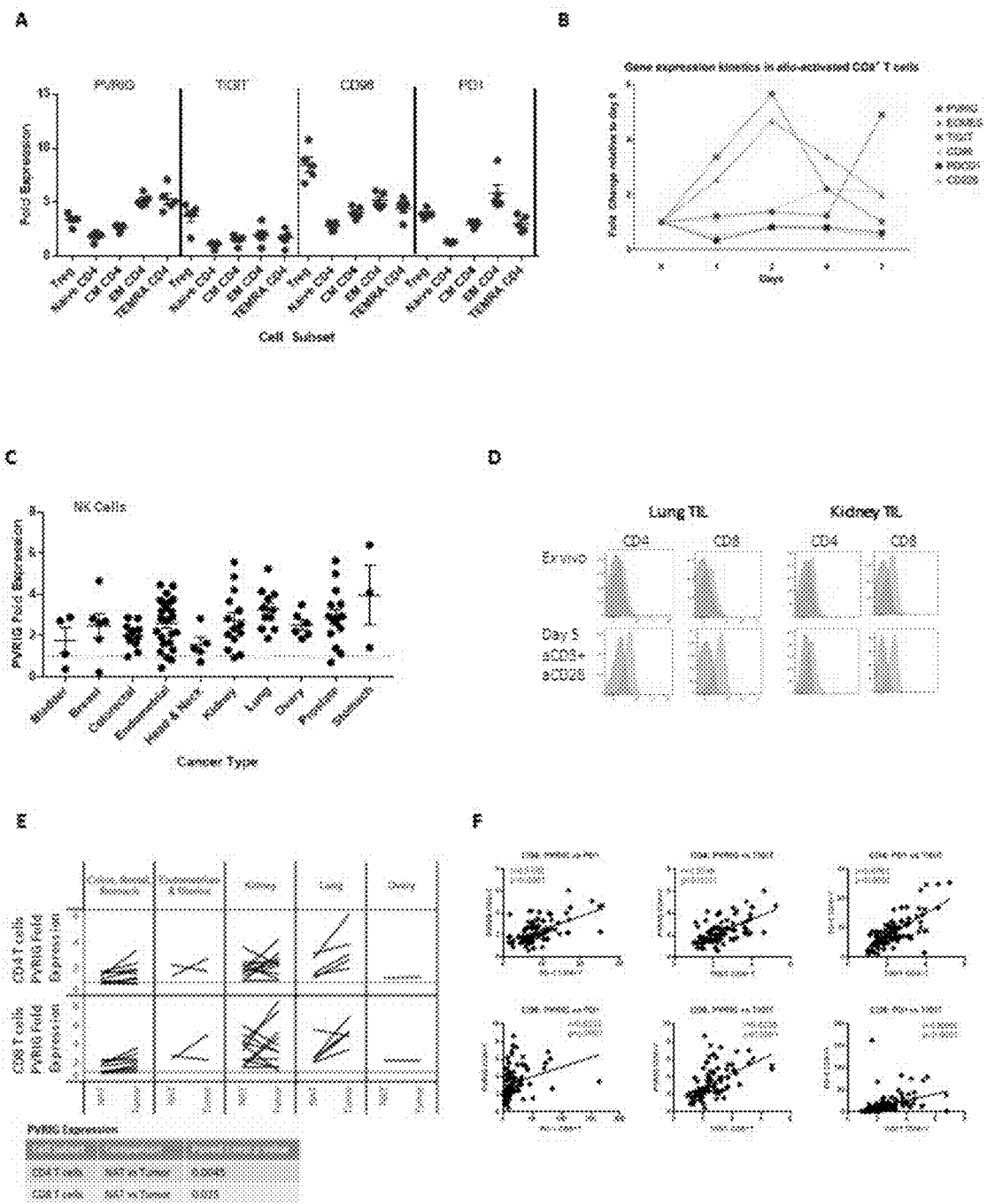

FIG. 34. PVRIG is expressed on T and NK cells of TILS in human cancer. A) Expression of PVRIG, TIGIT, CD96, and PD-1 on CD4 T cell subsets from healthy donor PBMCs is shown. Mean±SEM is shown. B) Human T cells were co-cultured with allogeneic PBMCs and expression of PVRIG protein on CD4 and CD8 T cells shown (top). C) Tumors were dissociated and single cells were activated with anti-CD3 and anti-CD28. Expression of PVRIG (blue) relative to IgG isotype control (red) was assessed on day 0 (directly ex vivo) and day 5 post activation. D) Expression of PVRIG on NK cells from dissociated human tumors is shown. Each dot represents a distinct tumor from an individual patient. Mean±95% confidence internal is shown. D) Dissociated tumor cells were activated with anti-CD3 and anti-CD28 beads for 5 days. Expression of PVRIG (blue) relative to IgG control (red) on CD4 and CD8 T cells on day 0 directly ex vivo and on day 5 post activation is shown for 2 dissociated tumor samples. E) Expression of PVRIG was assessed on CD4 and CD8 T cells from dissociated tumors and from dissociated donor-matched normal adjacent tissue. Each line represents matched tissues obtained from an individual patient. A paired student's t-test was performed. F) A correlation analysis of the magnitude of PVRIG, TIGIT, and PD-1 fold expression relative to IgG isotype control on CD4 and CD8 T cells from tumors is shown. Each dot represents an individual tumor sample. A Spearman's correlation coefficient and p value are shown.

Figure 35:
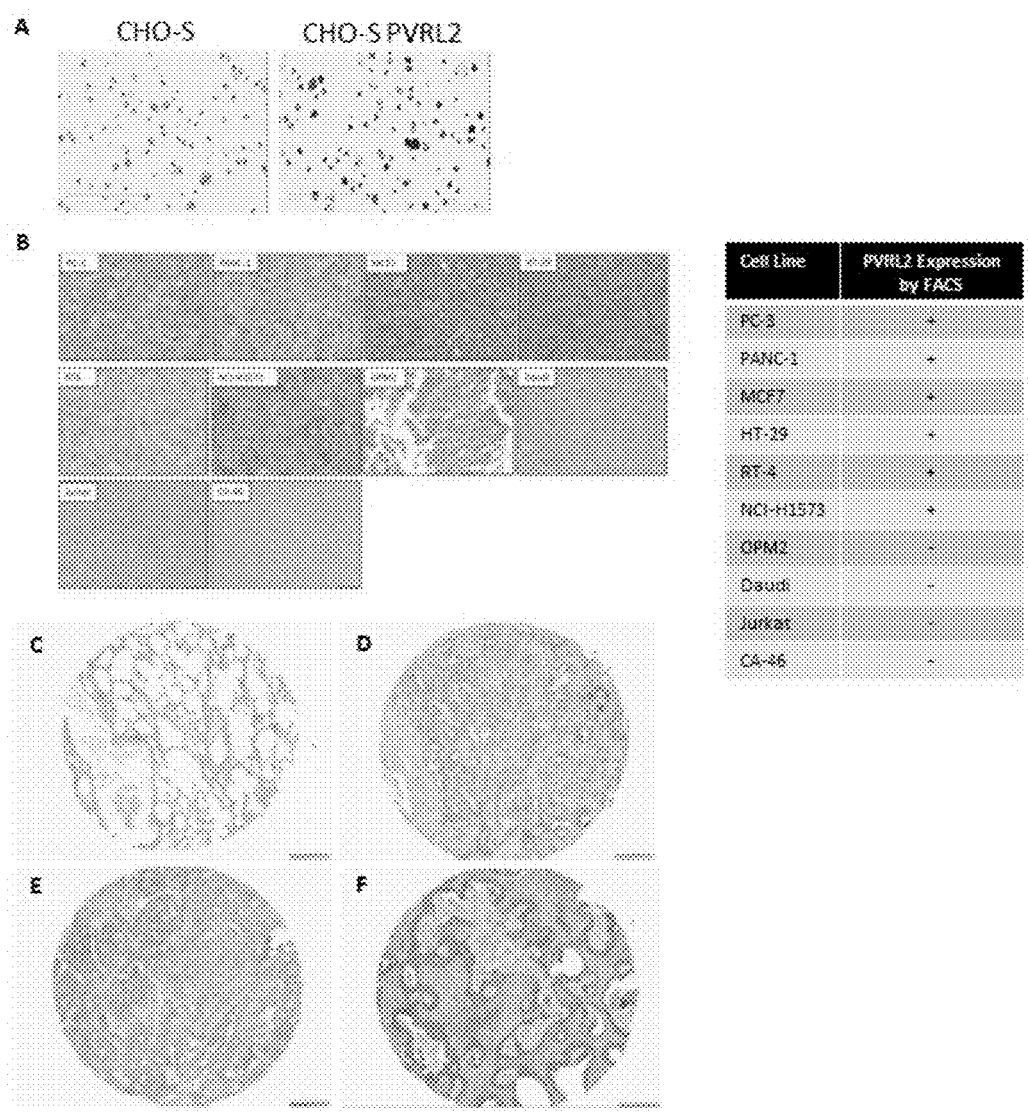

FIG. 35. Expression of PVRL2 is enhanced in colon, skin, and breast cancers. A) Photomicrographs showing the binding of Sigma anti human PVRL2 antibody to FFPE sections of positive cells, CHO—S human PVRL2 (right) compare to negative cells, CHO—S (left), following antigen retrieval at pH9. B) Anti-PVRL2 antibody was tested on a panel of PVRL2$^+$ (HT29, MCF7, PC3, PANC1, RT4, NCI-H1573) and PVRL2$^-$ (Jurkat, OPM2, Daudi, CA46) cell lines. C-F) Example expression of PVRL2 in lung normal and cancer tissues. C) Normal tissue showing no staining. D) Lung Adenocarcinoma showing partial positive staining. E) Lung adenocarcinoma showing positive staining. F) Lung adenocarcinoma showing strong positive staining.

Figure 36:
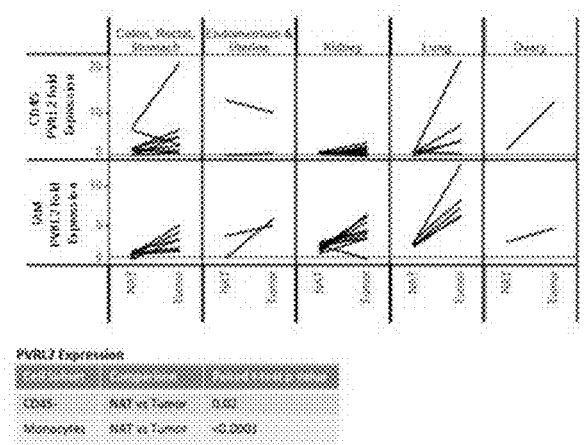

FIG. 36. PVRL2 is upregulated on TAMs and CD45$^-$ cells in the tumor as compared to normal adjacent tissue. Expression of PVRL2 on CD45$^-$ cells and TAMs from donor matched tumor and normal adjacent tissue is shown. A paired student's t-test p value is shown.

Figure 37:
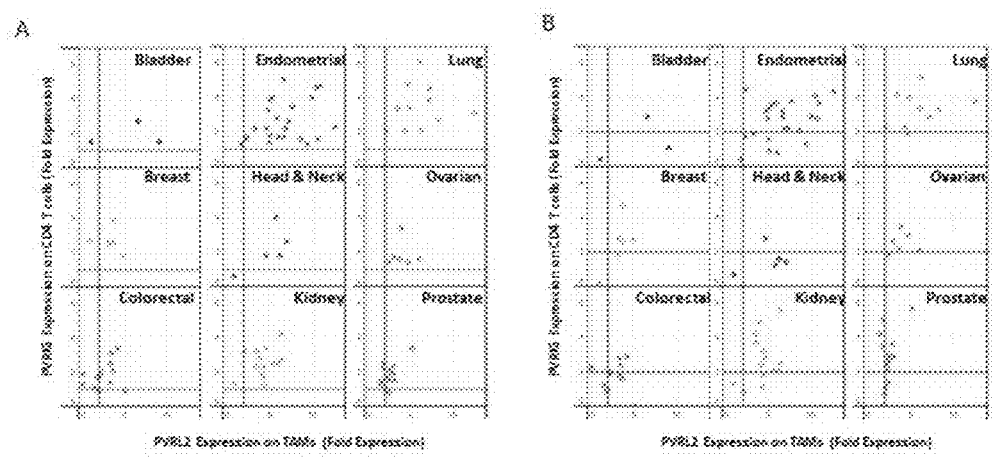

FIG. 37. PVRIG and PVRL2 are co-expressed in the same tumor sample. PVRIG expression on CD4 T cells (A) and NK cells (B) is plotted against PVRL2 expression on TAMS for an individual tumor.

Figure 38:
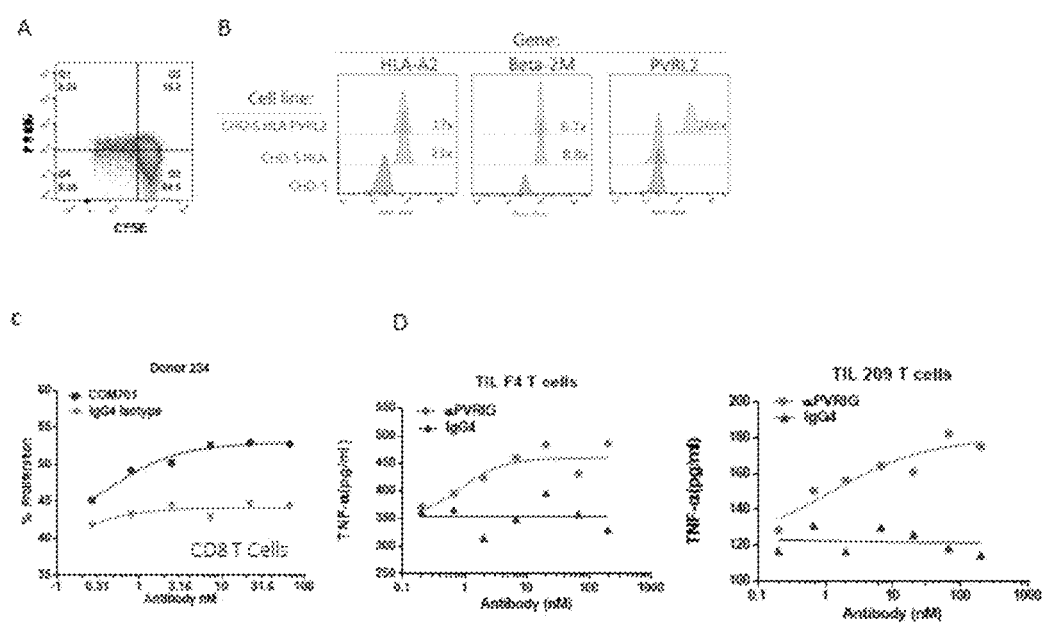

FIG. 38. Activity of CHA.7.518.1.H4(S241P) on human T cells. A) Expression of PVRIG on CD4 T cells activated with CHO cells expressing cell surface bound anti-CD3 and PVRL2. B) Expression of HLA-A2, B-2m, and PVRL2 are shown on CHO—S parental and engineered CHO—S cell lines. Fold expression relative to isotype is depicted by the number. C) CHO cells ectopically expressing cell surface bound anti-CD3 and PVRL2 were co-cultured with purified CD8 T cells in the presence of varying concentrations of anti-PVRIG Ab or relevant IgG control. % Proliferation is shown. Each dot represents an average of triplicate values. D) CHO cells ectopically expression HLA-A2/B2m and PVRL2 were co-cultured with 2 gp100 specific T cell lines (TIL F4, TIL 209) in the presence of 1 ug/ml gp100 and varying concentrations of anti-PVRIG antibody or relevant IgG control. TNF-α concentrations on day 3 of co-culture is down. Each value represents an average of triplicates.

Figure 39:
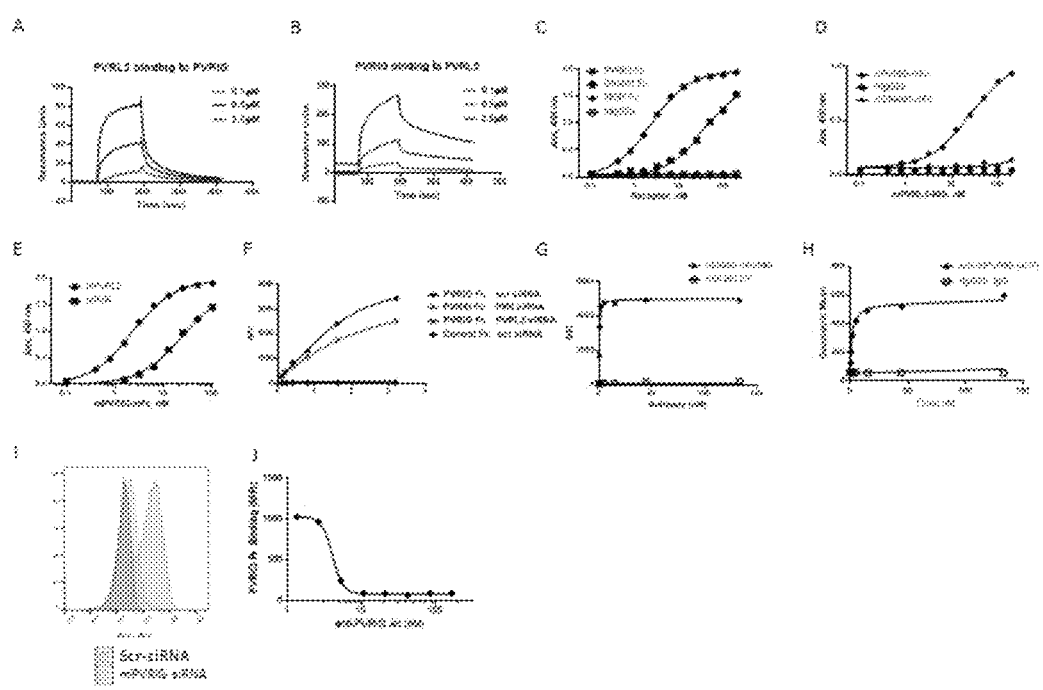

FIG. 39. Characterization of mPVRIG binding interactions and a surrogate anti-mPVRIG antibody. A, B) Binding of mPVRIG to mPVRL2 was assessed by surface plasmon resonance. C) Soluble receptor Fc or control proteins were incubated in a dose response with immobilized mPVRL2 HIS in an ELISA format. Bound receptor Fc is shown. D) Soluble PVRL2 HIS protein was incubated in a dose response with PVRIG Fc or DNAM Fc coated plates. E) Binding of mPVRIG Fc or control Fc fusion protein to B16-F10 cell line transfected with mPVRL2 siRNA, mPVRsRNA, or scrambled siRNA transfection is shown. F) Affinity characterization of rat anti-mouse PVRIG mAb was performed by examining the binding of anti-mPVRIG to HEK293 cells overexpressing mPVRIG. G) Affinity characterization of rat anti-mouse PVRIG mAb was performed by examining the of anti-mPVRIG to D10.G4.1 cell line endogenously expressing mPVRIG vs isotype control rat IgG is shown. H) Binding of anti-mPVRIG to D10.G4.1 cells transfected with mouse PVRIG-siRNA (green histogram) vs scr siRNA (orange histogram). I) Binding of mPVRIG Fc pre-incubated with anti-mPVRIG Ab to B16-F10 cells, which endogenously express PVRL2

FIG. 40. Generation of transgenic PVRIG and TIGIT knockout mice. The PVRIG conditional knockout and Tigit knockout mouse lines were generated by Ozgene Pty Ltd (Bentley W A, Australia). A) The targeting construct in which PVRIG exons 1 to 4 were floxed was electroporated into a C57BL/6 ES cell line, Bruce4 (Koentgen et al., Int Immunol 5: 957-964, 1993). B) The targeting construct in which the coding region of Tigit exon 1 (including the ATG) and exons 2 and 3 were replaced with an FRT-flanked neo cassette was electroporated into a C57BL/6 ES cell line, Bruce4. Homologous recombinant ES cell clones were identified by Southern hybridization and injected into goGermline blastocysts (Koentgen et al., genesis 54: 326-333, 2016). Male chimeric mice were obtained and crossed to C57BL/6J females to establish heterozygous germline offspring on C57BL/6 background. The germline mice were crossed to a ubiquitous FLP C57BL/6 mouse line to remove the FRT flanked selectable marker cassette and generate the conditional or knockout alleles (for PVRIG and Tigit, respectively). For PVRIG knockout, mice were further crossed to a ubiquitous Cre C57BL/6 mouse line to remove the loxP flanked exons and generate the knockout allele.

Figure 41:
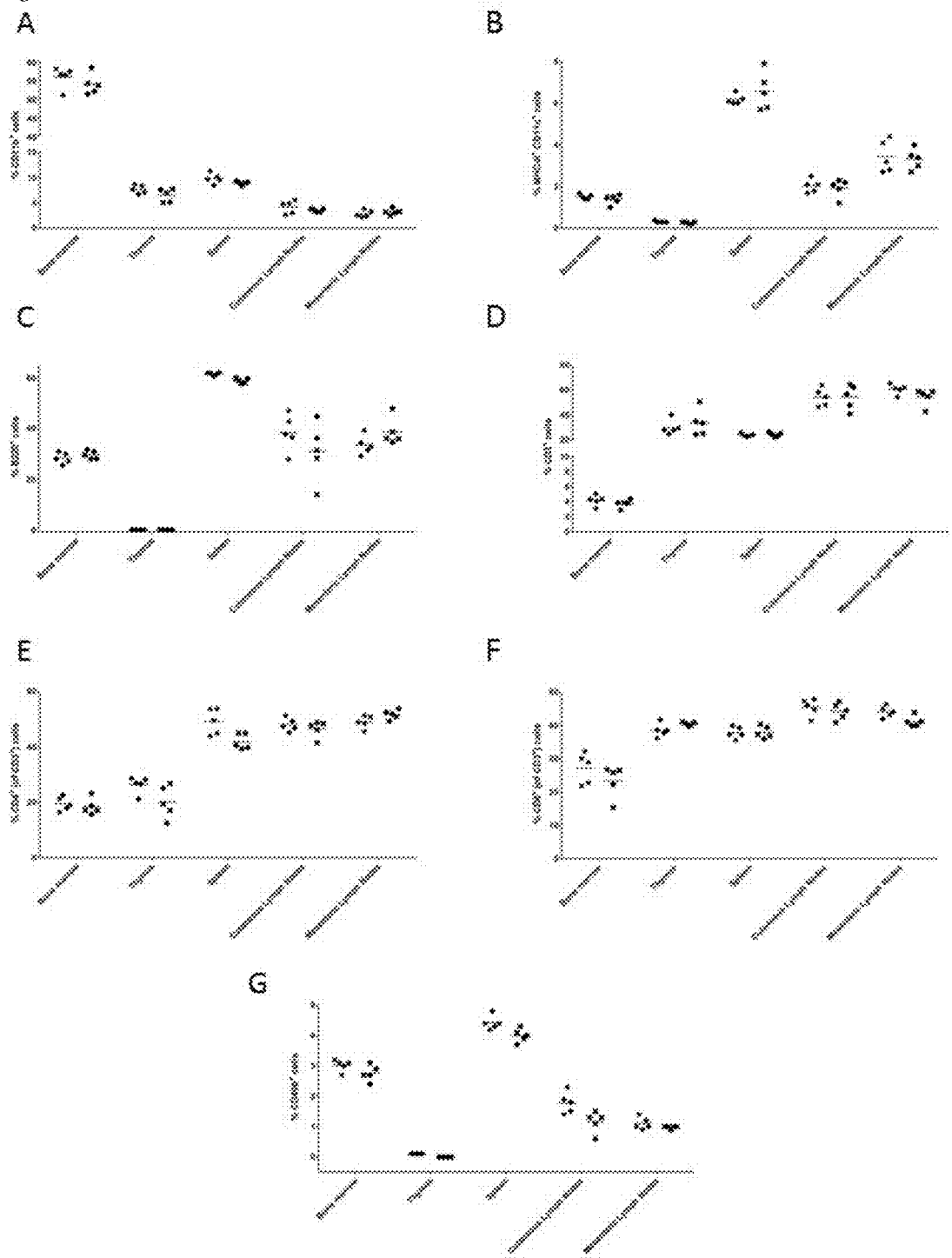
Figure 41:
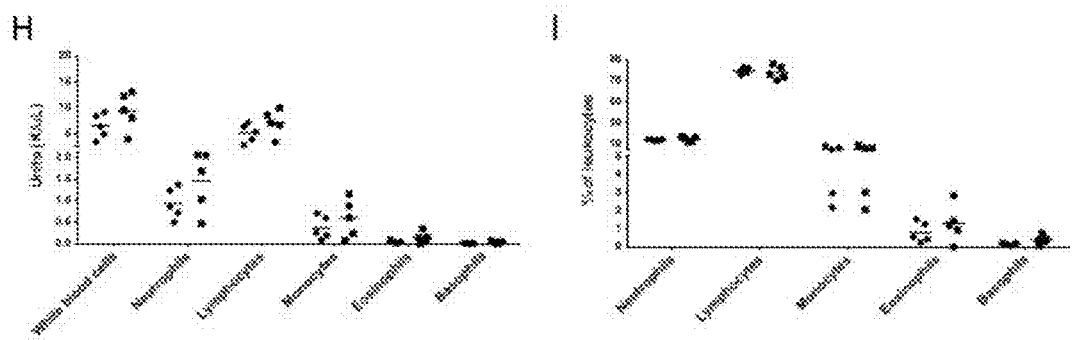

FIG. 41. PVRIG knockout mice are immune-phenotypically similar to wild-type mice. Mice (n=5 per wild-type and PVRIG knockout cohorts) were euthanized prior to venous blood being collected in anti-coagulant-coated tubes and harvesting of organs. Single cells were recovered from freshly harvested bone marrow, thymus, spleen, cutaneous and mesenteric lymph nodes. Cells were stained with fluorochrome-conjugated surface marker antibodies and acquired on a BD LSR Fortessa flow cytometer. Panels illustrate comparable frequencies of myeloid cells (A), dendritic cells (B), B cells (C), T cells (D), CD4 T cells (E), CD8 T cells (F), and NK cells (G) across lymphoid tissue types. (H-I) Whole venous blood was run on a Hemavet 950 veterinary hematology system to compare differential counts and frequencies of blood cell subsets from wild-type and PVRIG deficient mice.

Figure 42:
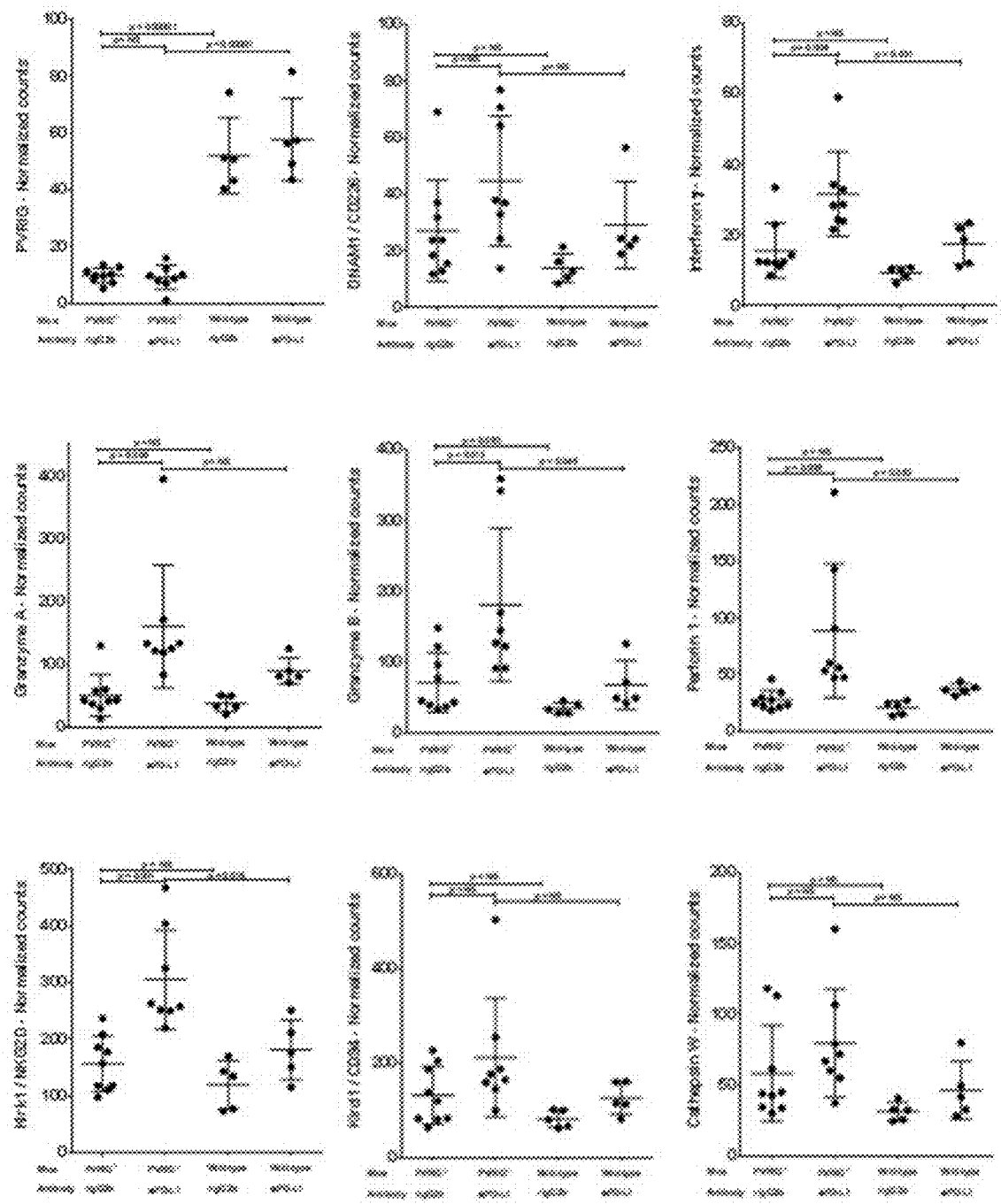

FIG. 42. Increased T cell effector function in PVRIG$^{-/-}$ mice treated with anti-PDL1 compared to WT with anti-PD-L1. MC38 tumors were inoculated into WT or PVRIG$^{-/-}$ mice and were subsequently treated with anti-PD-L1 or rat IgG2b isotype control. On day 18, CD45+ tumor infiltrating lymphocytes were purified from tumors, RNA extracted, and transcript profiling performed. Several T cell related genes are shown, with each dot representing an individual mouse. Student's t test p values are shown.

Figure 43:
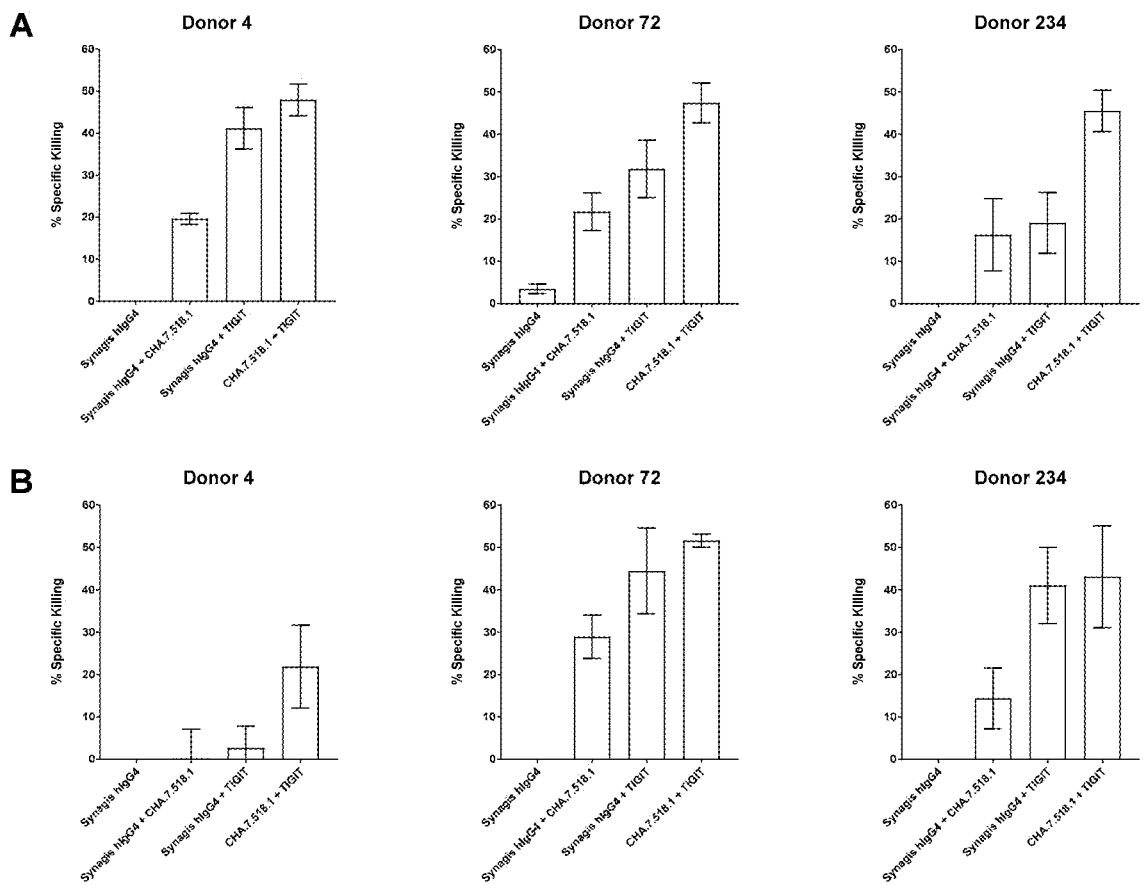

FIG. 43. Anti-TIGIT and anti-PVRIG antibodies induce tumor cell killing. An in vitro co-culture assay with human CMV-specific CD8+ T cells expanded was utilized to assess the effect of the benchmark anti-TIGIT antibody and CHA.7.518.1.H4(S241P) on antigen-specific tumor cell killing. HLA-A2+ target cell lines used in the assay were the Mel624 (A) and Panc05.04 (B). Synagis hIgG4 is the isotype control antibody. Luciferase activity in the target cells was measured with the Bio-Glo luciferase substrate. Representative data (n≥2) shows the percent specific killing (mean+/−standard deviation) of Mel624 or Panc05.04 cells after a 16 hour co-culture with human CMV-specific CD8+ T cells from three different donors.

Figure 44:
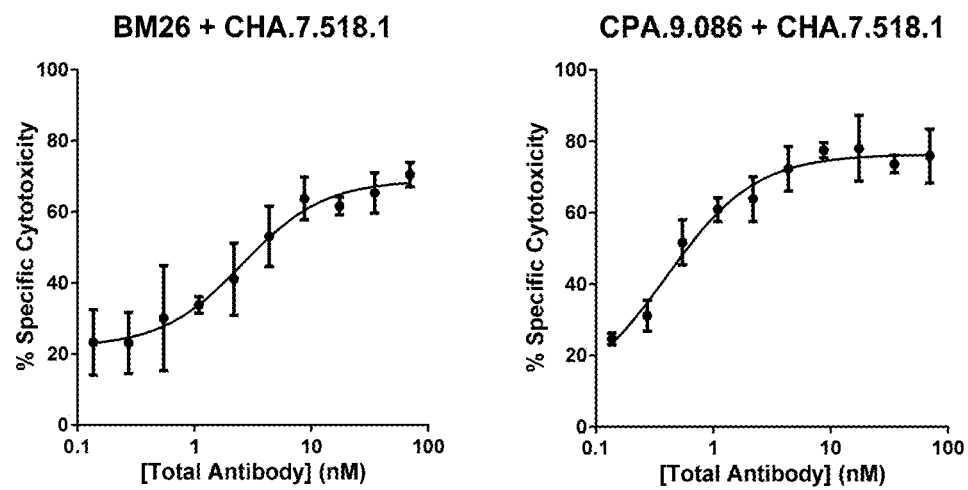

FIG. 44. Dose-dependent tumor cell killing of anti-TIGIT antibodies with CHA.7.518.1.H4(S241P). An in vitro co-culture assay with human CMV-specific CD8+ T cells was utilized to assess the effect of two different anti-TIGIT antibodies, BM26 and CPA.9.086 when combined with CHA.7.518.1.H4(S241P) on antigen-specific Mel624 cell killing. Luciferase activity in the target cells was measured with the Bio-Glo luciferase substrate. Representative data (n≥2) shows the percent specific killing (mean+/−standard deviation) of Mel624 cells after a 16 hour co-culture with human CMV-specific CD8+ T cells from one donor.

FIG. 45. CPA.9.086 CDR sequences, IMGT and Kabat numbering.

FIG. 46. Anti-TIGIT hIgG4+CHA.7.518.1.H4(S241P) combination induces tumor cell killing. Co-culture of CMV-reactive CD8+ T cells with Mel624 PVR, PVRL2 & luciferase OE Single dose of 10 µg/ml anti-TIGIT Ab and 10 µg/ml CHA.7.518.1.H4(S241P) with CMV-reactive donor 4, while dose titration starting at 0.5 µg/ml aTIGIT Ab and 10 g/ml CHA.7.518.1.H4(S241P) with CMV-reactive donor 156.

Figure 47:
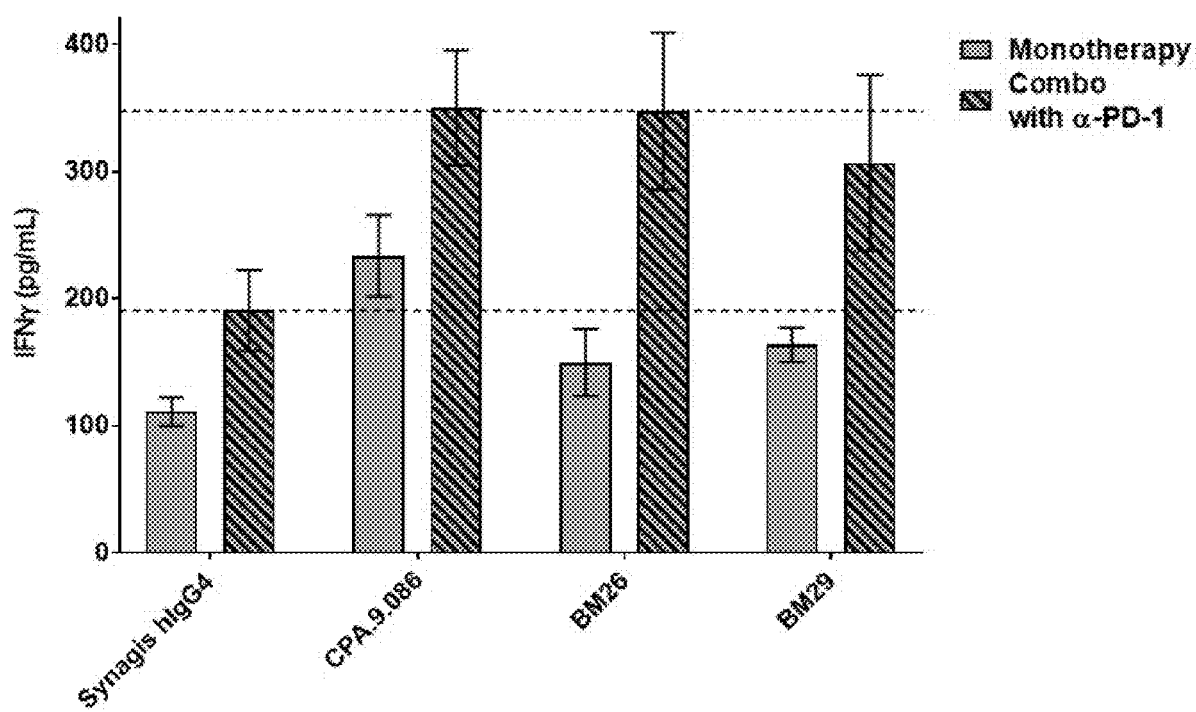

FIG. 47. Anti-TIGIT antibodies augment IFN-γ when combined with an anti-PD-1 antibody. An in vitro co-culture assay with human CMV-specific CD8+ T cells was utilized to assess the effect of CPA.9.086 compared to the benchmark antibodies, BM26 and BM29, on antigen-specific cytokine secretion in combination with an anti-PD-1 antibody, pembrolizumab. The target cell line used in the assay was the HLA-A2+ pancreatic adenocarcinoma cells, Panc.05.04 that endogenously expresses human PVR and PD-L1. Panc.05.04 cells were pulsed with the CMV pp65 peptide at 0.01 µg/ml at 37° C. for 1 hour. Cells were then washed and plated at 50,000 cells/well in 96-well round-bottom tissue culture treated plates. Anti-human TIGIT antibodies or the isotype control hIgG4 antibody (anti-Synagis) were added at a concentration of 0.1 µg/ml in combination with the anti-PD-1 antibody (hatched bars) or a control hIgG4 isotype antibody at 10 µg/ml (solid bars). Human CMV-specific CD8+ T cells from a single donor were expanded according to the protocol above. 50,000 human CD8+ T cells were added to each well. Co-cultures were incubated at 37° C. with 5% $CO_2$ for 24 hours. The amount of human IFN-γ in the co-culture supernatant was measured by flow cytometry using a cytometric bead assay (BD Biosciences).

Figure 48:
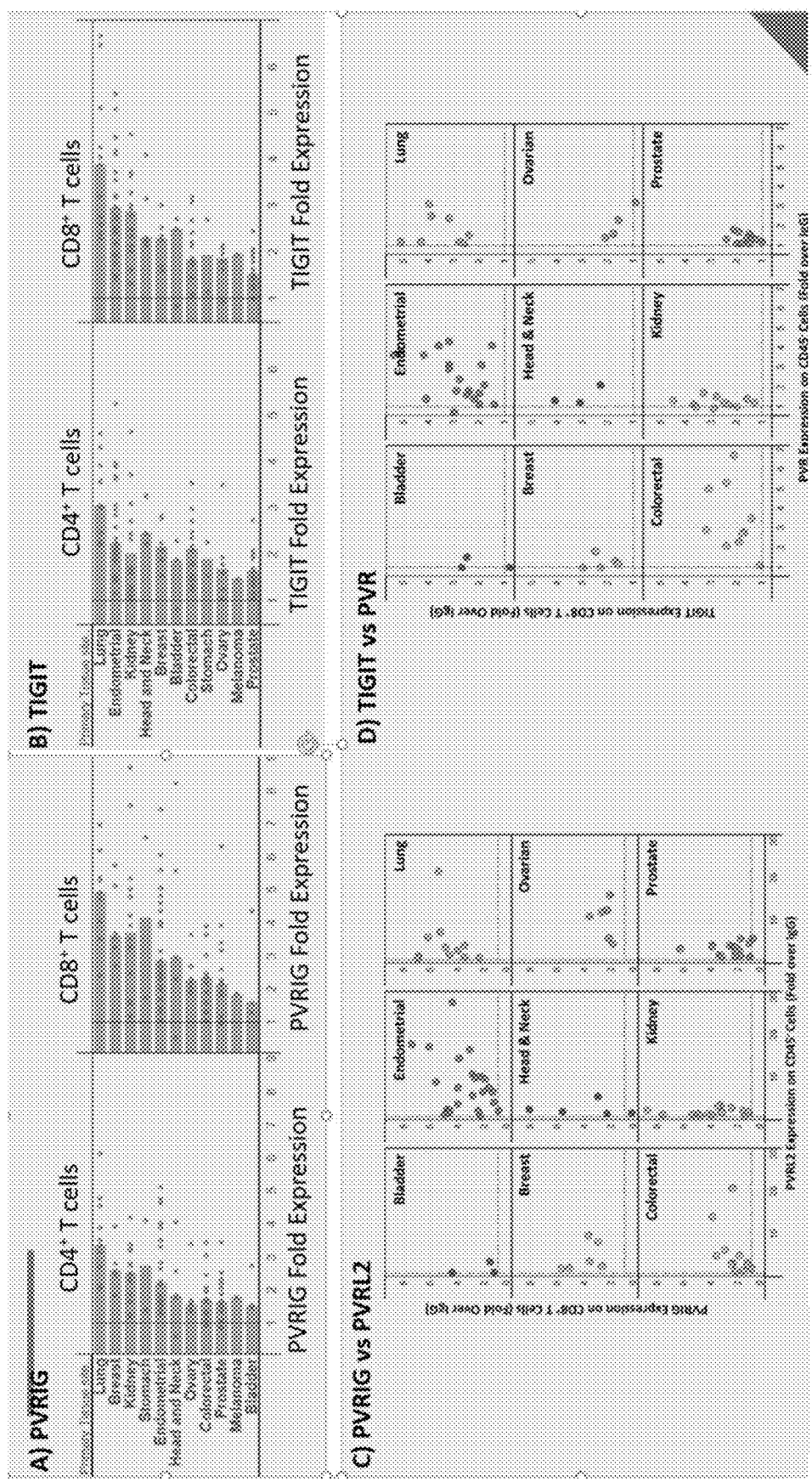

FIG. 48 depicts expression profiling of PVRIG/TIGIT axis in tumors; lung and endometrial cancers are high for both PVRIG-PVRL2 and TIGIT-PVR pathway. (A, B) PVRIG and TIGIT expression were analyzed on CD4$^+$ and CD8$^+$ T cells from dissociated human tumors by FACS. Fold expression was calculated by dividing the MFI of PVRIG or TIGIT by the MFI of the IgG control. Grey line=No expression detected. Each orange dot is a distinct tumor sample and median of samples shown by the blue bar. C, D) Expression of PVRIG on CD8$^+$ T cells vs PVRL2 on CD45$^-$ cells or TIGIT on CD8$^+$ T cells vs PVR on CD45$^-$ cells is plotted from dissociated tumors. Each dot represents an individual tumor sample.

Figure 49:
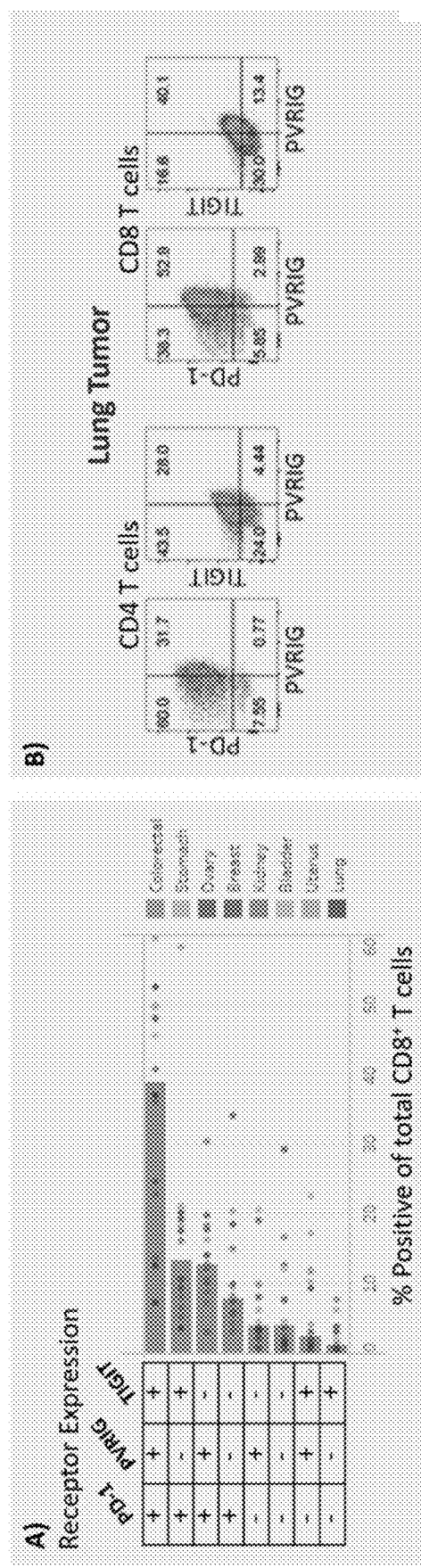
Figure 49:
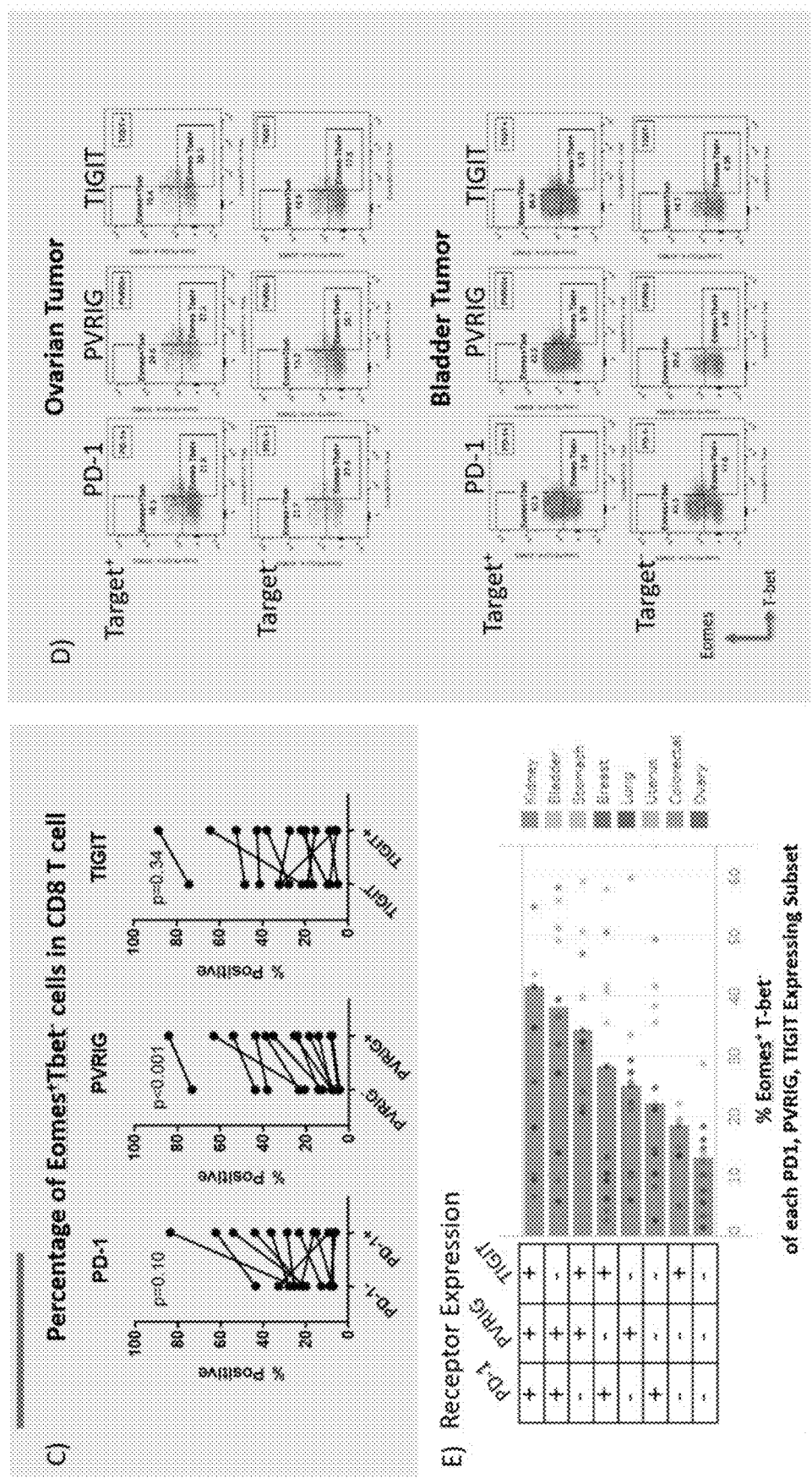

FIG. 49 depicts expression data for PD-1, PVRIG and TIGIT on CD8 T cells, which shows that PVRIG+TIGIT+PD-1+ CD8+ TILs are highly prevalent and have an exhausted profile. A) TILS from human cancers were stained for PD1, PVRIG, and TIGIT expression on CD8 T cells. The percentage of cells that express combinations of PD-1, PVRIG, or TIGIT on CD8+ T cells was determined by Boolean gating. B) Representative PD-1, PVRIG, and TIGIT expression on CD4+ and CD8+ T cells from a lung tumor are shown. C) TILS from human cancers were stained for cell surface PD1, PVRIG, and TIGIT on CD8+ T cells, permeabilized, and stained for Eomes and T-bet. Within each cell subset, the percentage of Eomes+T-bet- cells are shown. A paired Student's t-test was performed and p values shown. D) Representative FACS plots showing Eomes and T-bet expression on PD-1, PVRIG, or TIGIT expressing CD8 T cells from an ovarian and bladder tumor are shown. E) Percentage of Eomes+T-bet- cells expressing cells based on PD-1, PVRIG, and TIGIT expression was determined. Thus, PVRIG expression correlates with Eomes+T-bet-transcription factor expression, a phenotype known to be associated with T cell exhaustion. Triple positive PVRIG+TIGIT+PD-1+ cells were also high in percentage of Eomes+ T-bet-cells.

Figure 50:
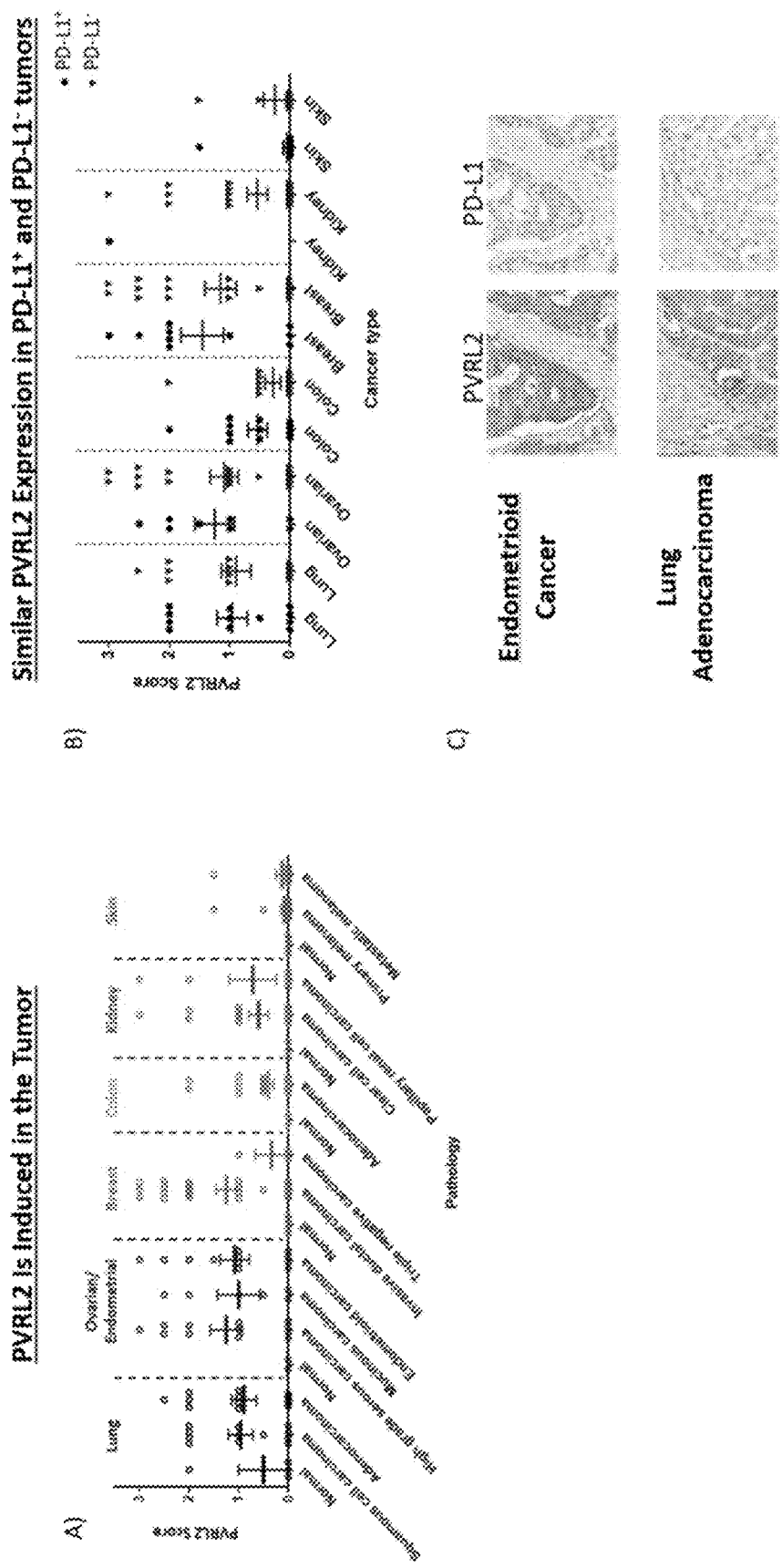

FIG. 50 shows that PVRL2 is induced in cancer and expressed in PD-L1-tumors. A) PVRL2 expression was assessed by IHC on lung, ovarian/endometrial, breast, colon, kidney, and skin tumors. Bars depict mean±SEM. For each tumor, 2 cores were assessed by a pathologist and scored based on prevalence and intensity of membranous staining on tumor cells. For each tumor, the average score of 2 cores is shown. B) Expression of PD-L1 and PVRL2 was assessed by IHC on serial sections. Tumors were grouped based on tissue type and expression of PVRL2 on PD-L1 negative and PD-L1 positive is shown. PD-L1 negative tumors were defined as no membranous staining on tumor or immune cells from either duplicate cores for a given tumor. PD-L1 positive staining was defined as membranous staining on at least 1 core of a tumor. Bars depict mean±SEM for each group. C) Representative expression of a PVRL2+PD-L1− endometrioid carcinoma tumor and a PVRL2+PD-L1− lung tumor.

Figure 51:
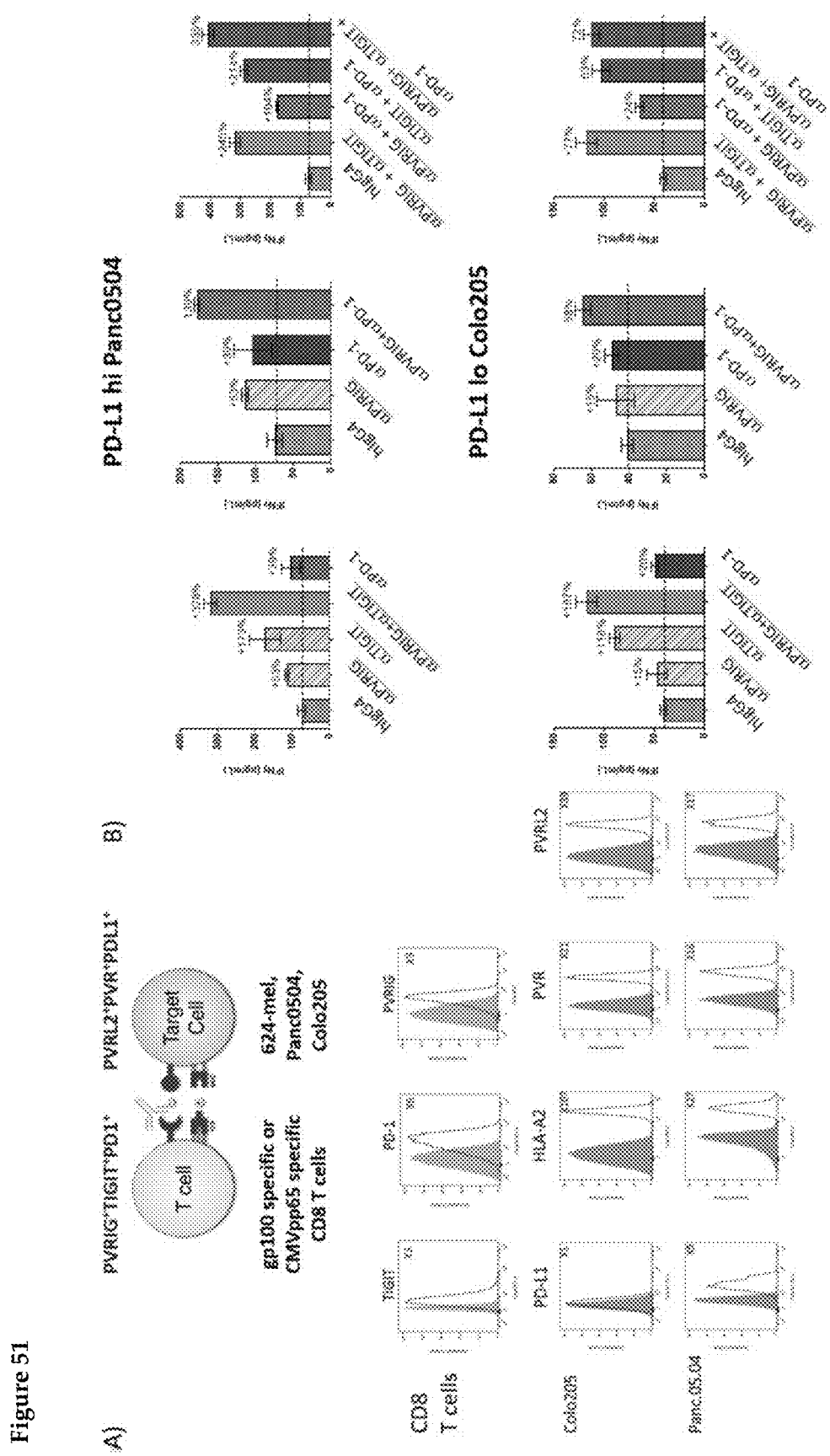

FIG. 51 shows that anti-PVRIG/TIGIT/PD-1 synergistically increases T cell function. (A) CMVpp65 CD8 T cells were stained for TIGIT/PD-1/PVRIG expression, and tumor cell lines were stained for PD-L1, HLA-A2, PVR & PVRL2. Representative FACs histograms are shown. B) CMVpp65 specific T cells were co-cultured with Panc0504 & Colo205 cells, CMVpp65 peptide and the indicated antibodies at 10 ug/ml. IFN-γ concentration in the conditioned media was determined at 18 hrs. Percentages above bar graphs is % increase in IFN-γ secretion over isotype IgG.

Figure 52:
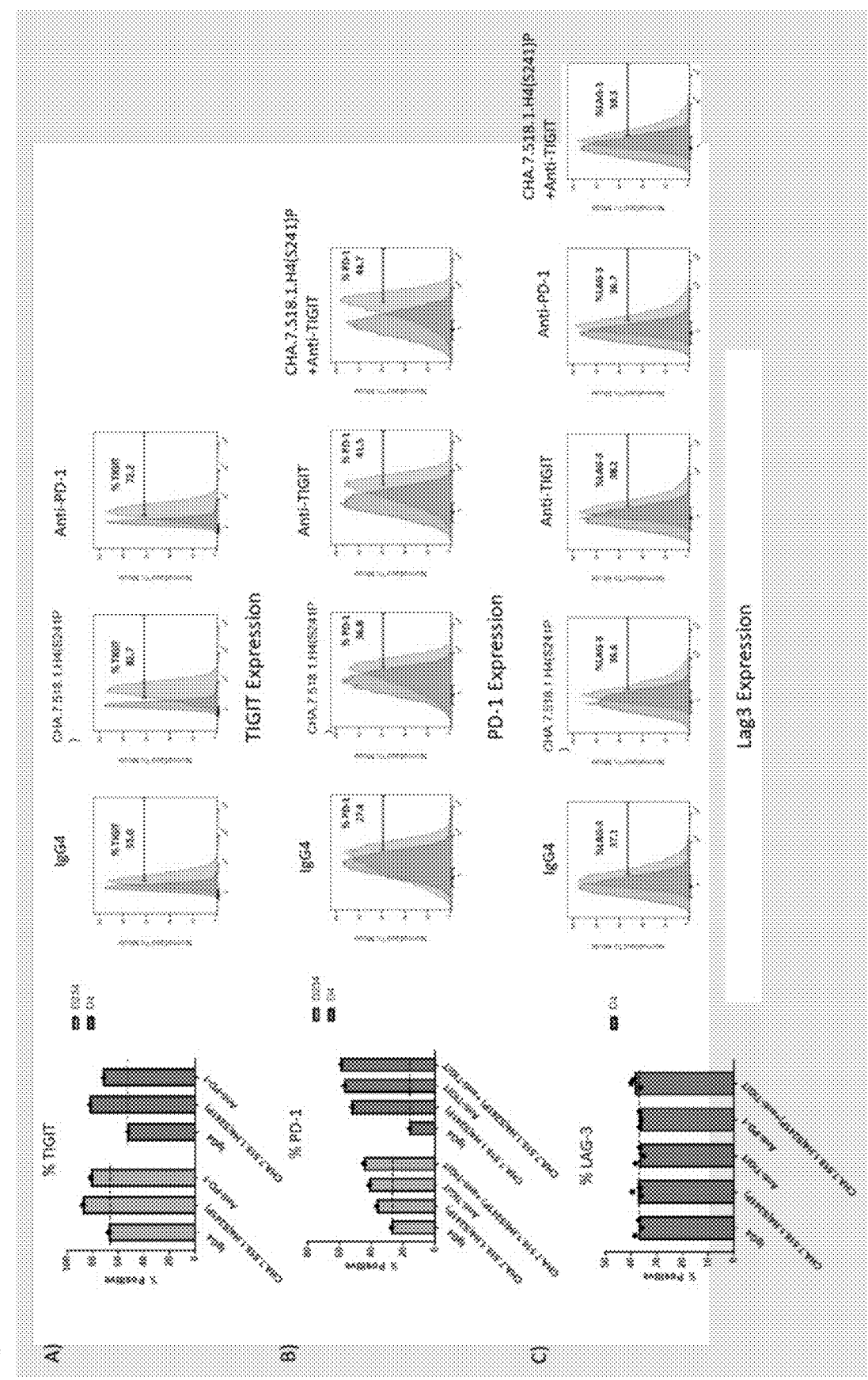

FIG. 52 shows that the blockade of the PVRIG-PVRL2 interaction induces PD-1 and TIGIT expression. CMVpp65 specific T cells from 1-2 donors were co-cultured with Panc0504, CMVpp65 peptide, and the indicated antibodies at 10 ug/ml for 18 hours. Cells were then stained for FACs and the percentage of cells PD-1, TIGIT, and LAG3 for each treatment condition is shown. Representative histograms for each receptor is shown. Red=Isotype, Blue=Target expression. A) TIGIT expression was induced by CHA7.518.1.H4 (S241P) or anti-PD1 treatment. (B) PD-1 expression was induced by CHA7.518.1.H4(S241P) and/or CPA.9.083.H4 (S241P). (C) LAG-3 expression was not induced by CHA7.518.1.H4(S241P), anti-TIGIT, or anti-PD-1.

Figure 53:
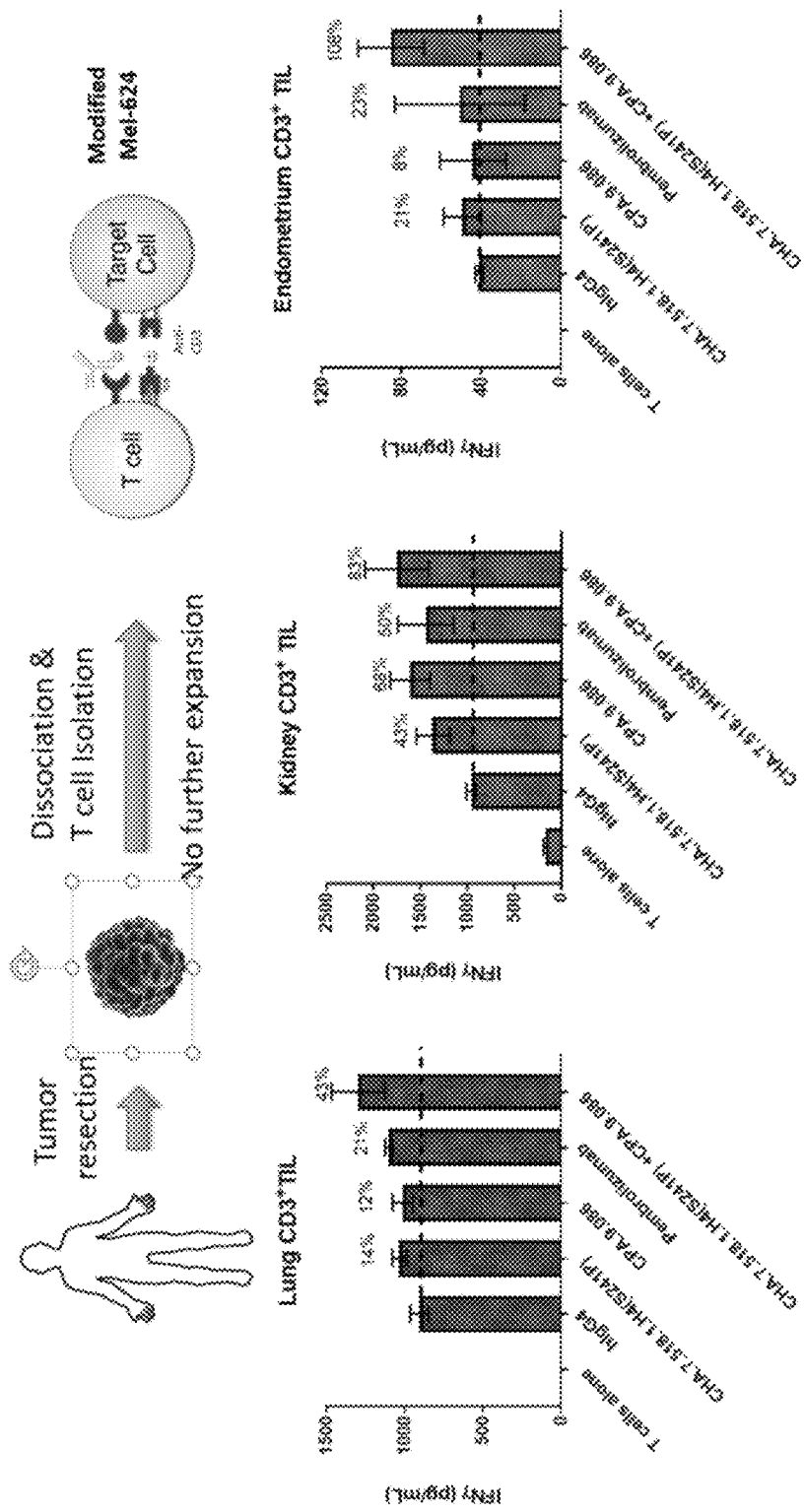

FIG. 53. Tumors obtained within 24 hrs of surgical resection were dissociated and purified CD3+ TILS co-cultured with MEL624 cells expressing surface bound anti-CD3 and the indicated antibodies at 10 ug/ml. IFN-γ concentration in the conditioned media was determined at 72 hrs. % change in IFN-γ for each condition relative to hIgG4 is shown.

FIG. 54. PVRIG ANTIBODY BLOCKADE OR DEFICIENCY RESULT IN REDUCED TUMOR GROWTH. PVRIG antibody blockade or deficiency inhibit tumor growth. A) BALB/c mice were subcutaneously injected with 5×105 CT26 cells. At day 7 post inoculation mice were treated with anti-PD-L1 and/or anti-PVRIG antibodies, twice weekly for 3 weeks. Tumor volumes are shown. n=10 mice per group. Mean+/−SEM is shown. *** Indicates p-value<0.001 (ANOVA with repeated measures) for anti-PD-L1$^+$ Rat IgG2b compared to anti-PD-L1$^+$ anti-PVRIG treated groups. B) C57BL/6 WT or PVRIG−/− mice were subcutaneously injected with 5×105 MC38 cells. n=10 mice per group. Mean+/−SEM is shown. *Indicates p-value<0.05 for WT mice versus PVRIG−/− mice (ANOVA with repeated measures). Individual tumor growth curves are also shown. Representative data from n=2 experiments.

Figure 55:
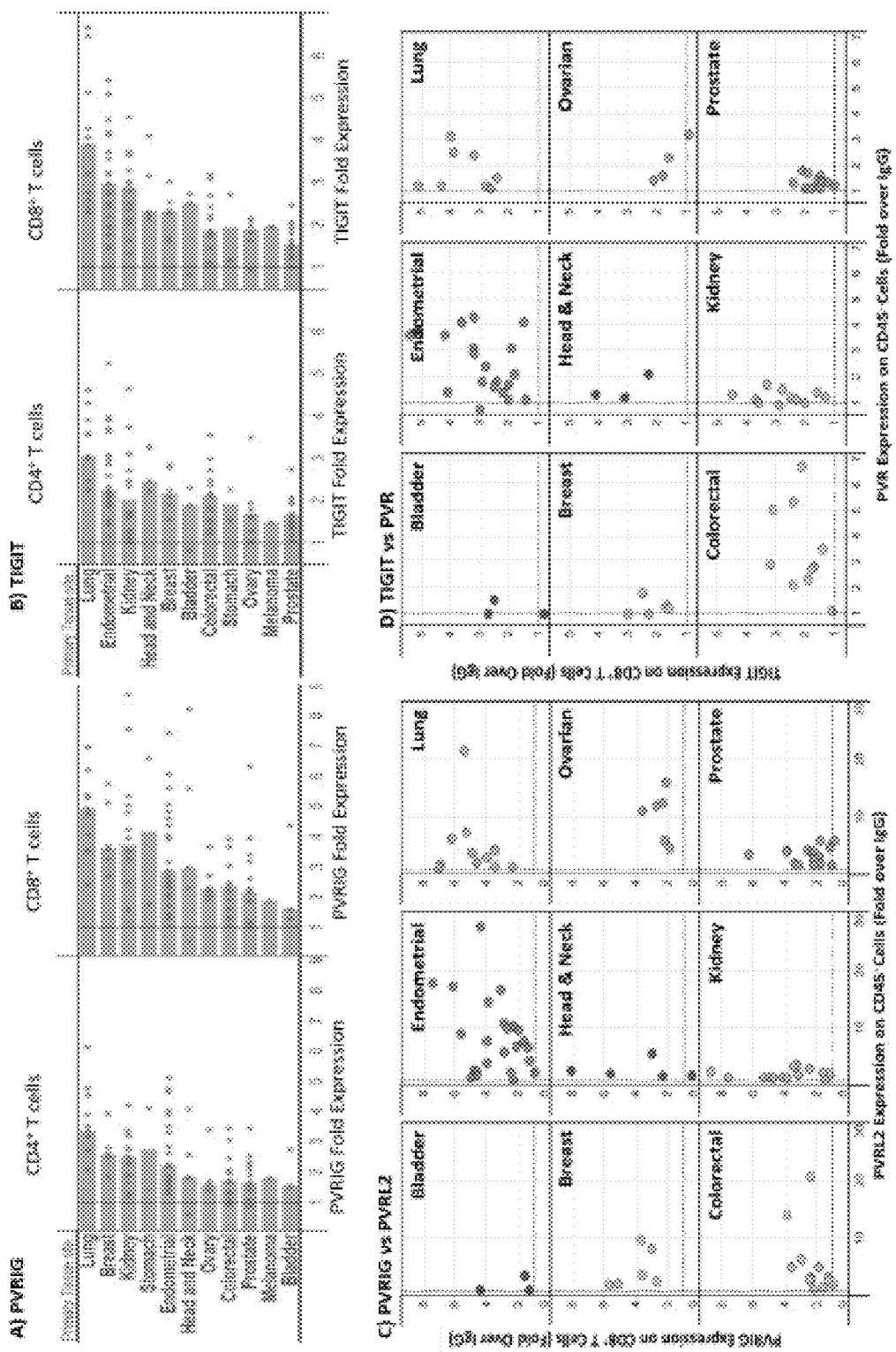

FIG. 55. EXPRESSION PROFILING OF PVRIG/TIGIT AXIS IN HUMAN TUMORS. Lung and endometrial cancers are high for both PVRIG-PVRL2 and TIGIT-PVR pathway. (A, B) PVRIG and TIGIT expression were analyzed on CD4$^+$ and CD8$^+$ T cells from dissociated human tumors by FACS. Fold expression was calculated by dividing the MFI of PVRIG or TIGIT by the MFI of the IgG control. Grey line=No expression detected. Each orange dot is a distinct tumor sample and median of samples shown by the blue bar. C, D) Expression of PVRIG on CD8$^+$ T cells vs PVRL2 on CD45− cells or TIGIT on CD8$^+$ T cells vs PVR on CD45− cells is plotted from dissociated human tumors. Each dot represents an individual tumor sample.

Figure 56:
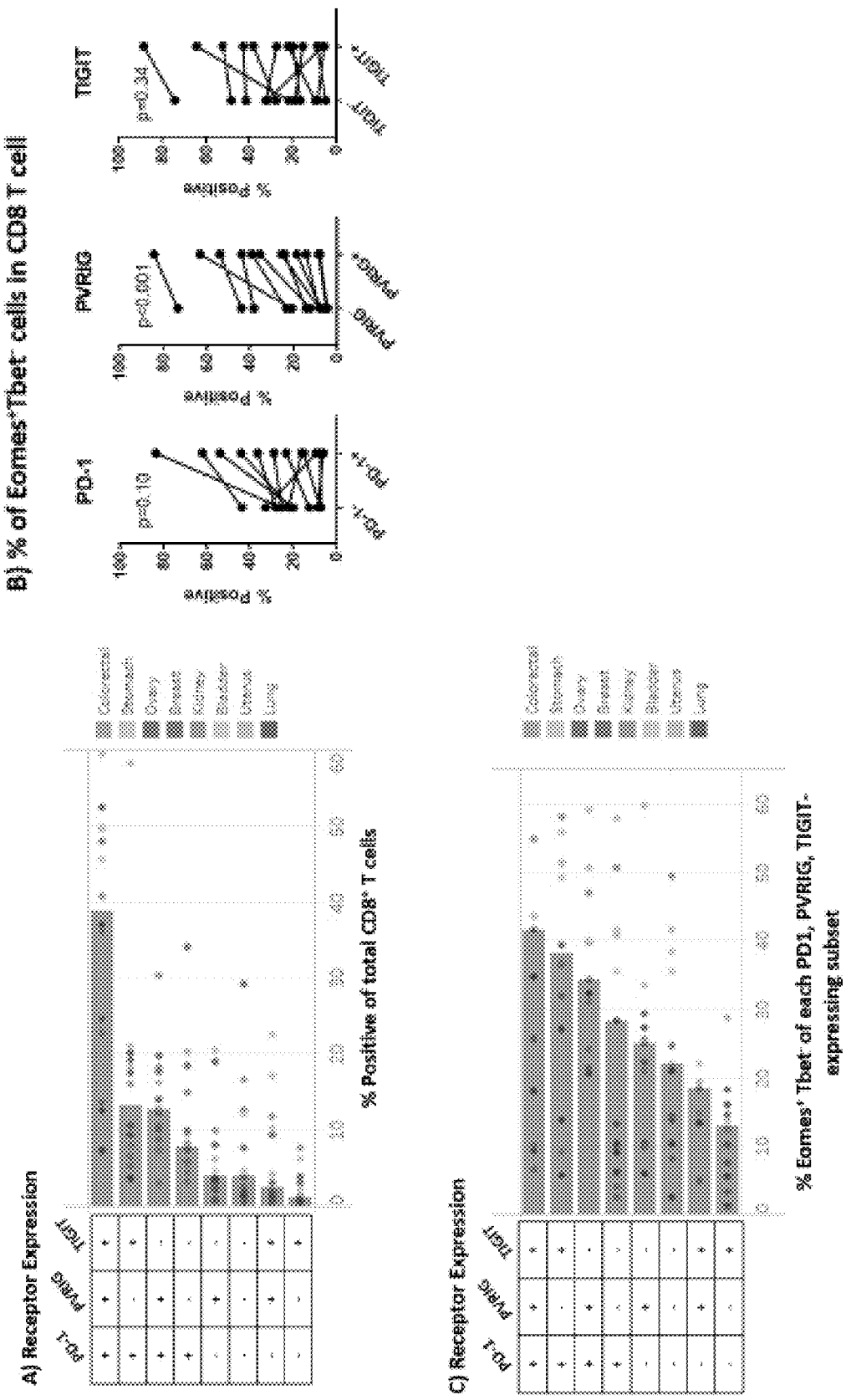

FIG. 56. PVRIG+TIGIT+PD1+ CELLS ARE THE HIGHEST % AND MOST EXHAUSTED OF CD8+ TILS. PVRIG+TIGIT+PD1+ CD8+ TILs are highly prevalent and have an exhausted phenotype. A) CD8$^+$ TILs from human cancers were stained for PD-1, PVRIG, and TIGIT. The percentage of CD8$^+$ TILs that express combinations of PD-1, PVRIG, or TIGIT on CD8$^+$ T cells was determined by Boolean gating. Each dot represents an individual tumor sample. B) CD8$^+$ TILs from human cancers were stained for cell surface PD1, PVRIG, and TIGIT, permeabilized, and stained for intracellular Eomes and T-bet. The percentage of Eomes$^+$T-bet− CD8$^+$ T cells are shown. A paired Student's t-test was performed and p-values shown. C) The percentage of Eomes$^+$ T-bet− CD8$^+$ T cells expressing PD-1, PVRIG, and TIGIT was determined across multiple human cancers.

Figure 57:
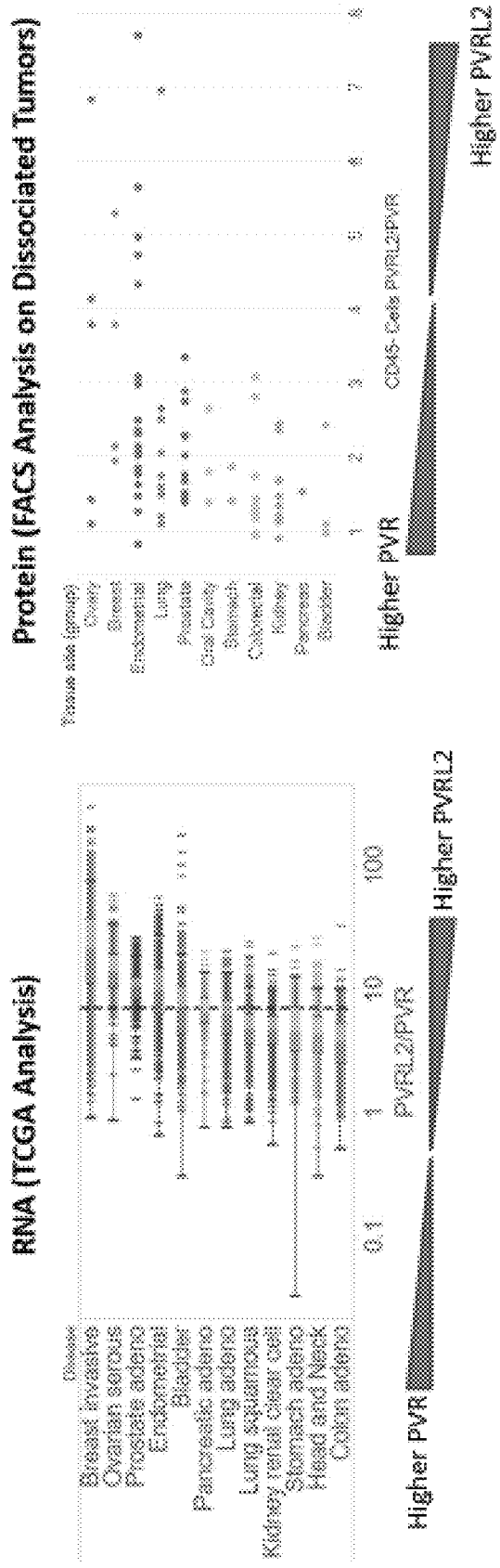

FIG. 57. RELATIVE EXPRESSION OF PVRL2 VERSUS PVR VARIES BY TUMOR TYPE. Relative RNA and protein expression of PVRL2 and PVR across different human tumors. RNA expression of PVRL2 and PVR from the TCGA was plotted as a ratio of PVRL2 relative to PVR across multiple human tumors (left hand panel). Tumors with higher PVRL2 RNA expression compared to PVR include breast, ovarian, prostate, endometrial, bladder, pancreatic and lung. The ratio of protein expression (gMFI) of PVRL2 relative to PVR on CD45− tumor cells is plotted from dissociated human tumors (right hand panel). Each dot represents an individual tumor sample. Tumors with higher PVRL2 protein expression compared to PVR include ovary, breast, endometrial, lung, prostate, oral cavity and stomach. Higher RNA expression correlates with higher protein levels for PVRL2 across several tumors, including breast, ovarian, endometrial, prostate, and lung cancers.

Figure 58:
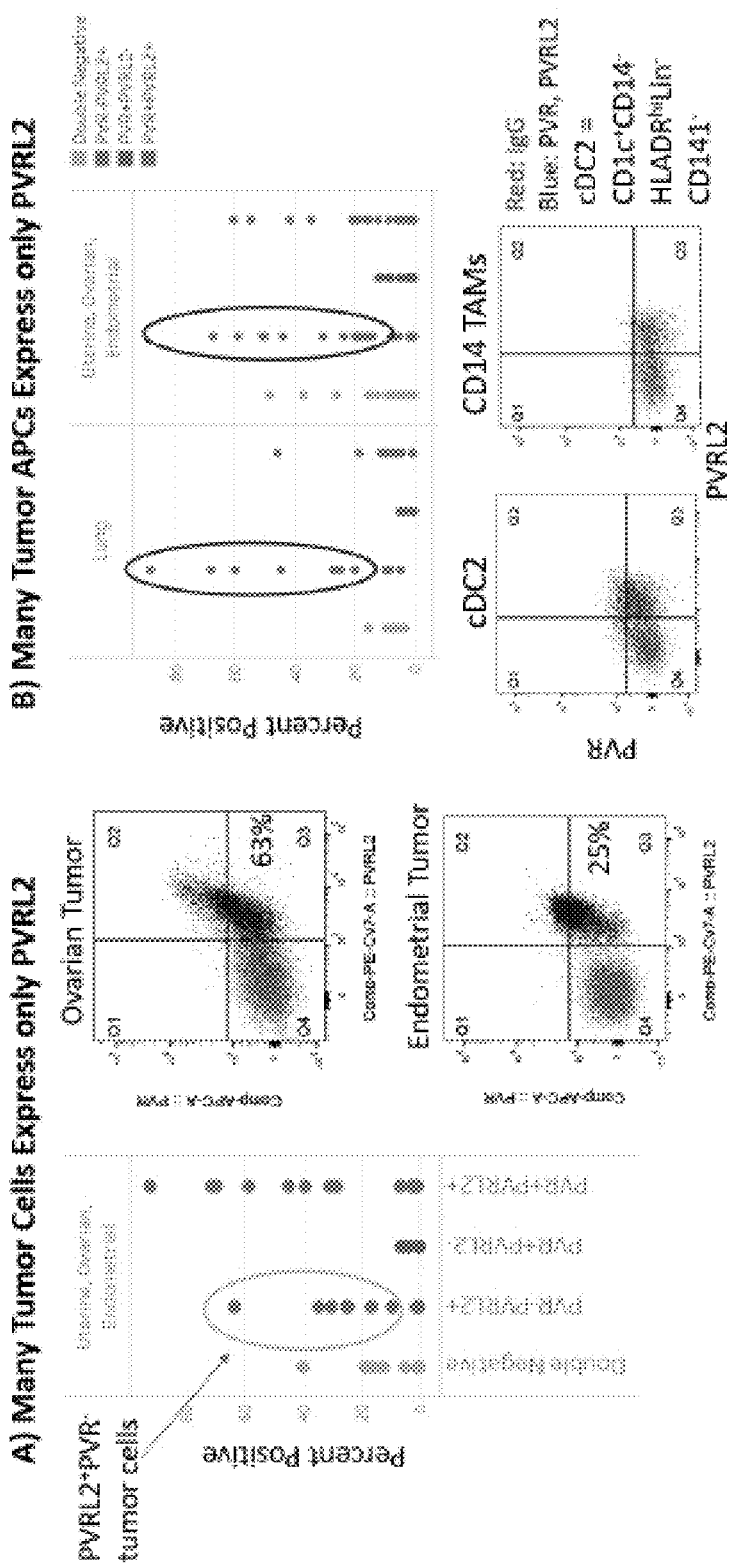

FIG. 58. PVRL2+PVR− TUMOR CELLS AND APCs EXIST IN HUMAN TUMORS. PVRL2+PVR− tumor cells and APCs are present in human tumors. PVRL2 and PVR expression from dissociated tumors determined by FACS on A) CD45− tumor cells, and B) cDC2 (CD1c$^+$CD14-HLA-DR$^{hi}$Lin$^-$CD141$^-$) and CD14$^+$ TAMs is plotted. PVRL2$^+$PVR− tumor cells and APCs are represented as red dots in the percent positive plots. Representative FACS plots for PVRL2 and PVR expression (blue) as compared to an IgG isotype control (red) are shown for ovarian and endometrial tumors.

Figure 59:
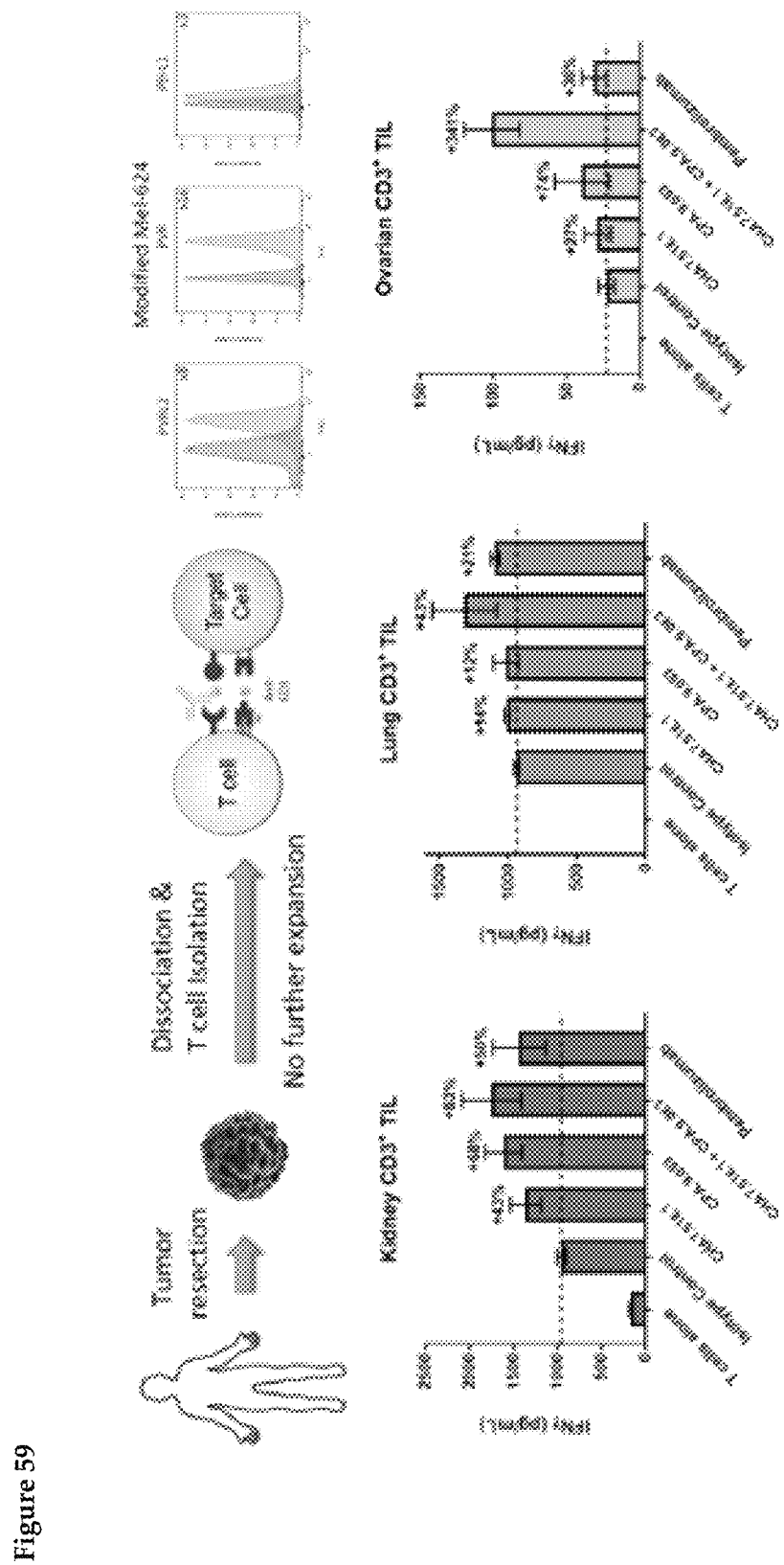

FIG. 59. CHA7.518.1.H4(S241P)+CPA.9.083.H4(S241P) COMBO HAS ACTIVITY≥PEMBROLIZUMAB ON PRIMARY CD3+ TILS. CHA7.518.1.H4(S241P) and/or CPA.9.083.H4(S241P) have similar or greater potency than Pembrolizumab on freshly isolated human TILs. Human tumors obtained within 24 hours of surgical resection were dissociated and CD3$^+$ TILs were purified. Isolated CD3$^+$ TILs were co-cultured with a modified Mel-624 tumor cell line, expressing surface bound anti-CD3, and the indicated antibodies at 10 μg/ml. IFN-γ secretion in the conditioned media was measured at 72 hours. The percentage change in IFN-γ for each treatment over the hIgG isotype control is shown.

Figure 60:
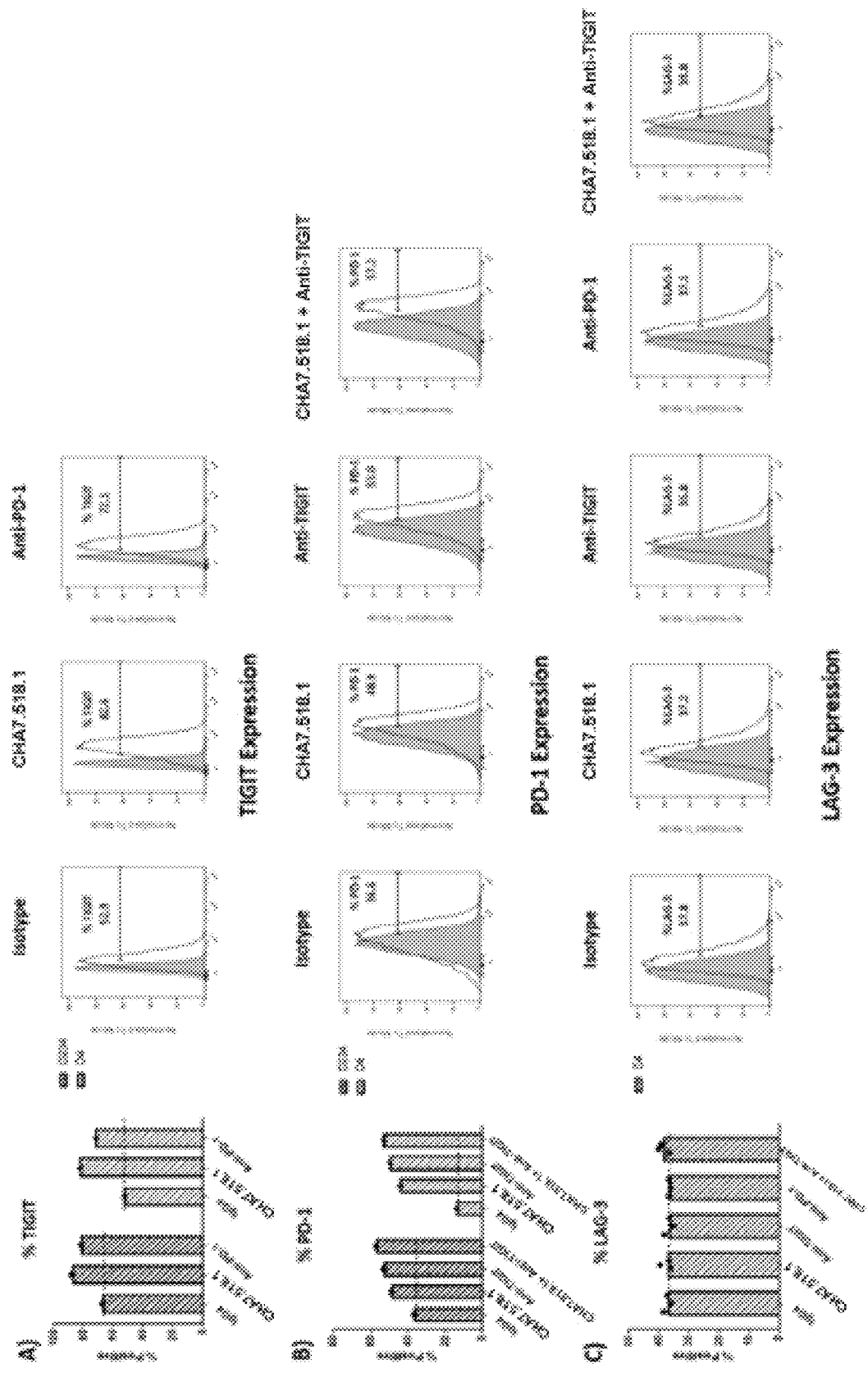

FIG. 60. BLOCKADE OF PVRIG/PVRL2 INDUCES PD-1 AND TIGIT EXPRESSION. Blockade of PVRIG/PVRL2 induces PD-1 & TIGIT expression. CMVpp65-specific CD8$^+$ T cells from 2 donors were co-cultured with Panc.05.04, CMVpp65 peptide, and the indicated antibodies at 10 μg/ml for 18 hrs. Cells were stained and the percentage of A) TIGIT$^+$, B) PD-1$^+$, and C) LAG3$^+$ CD8$^+$ T cells following each treatment is shown.

Figure 61A:
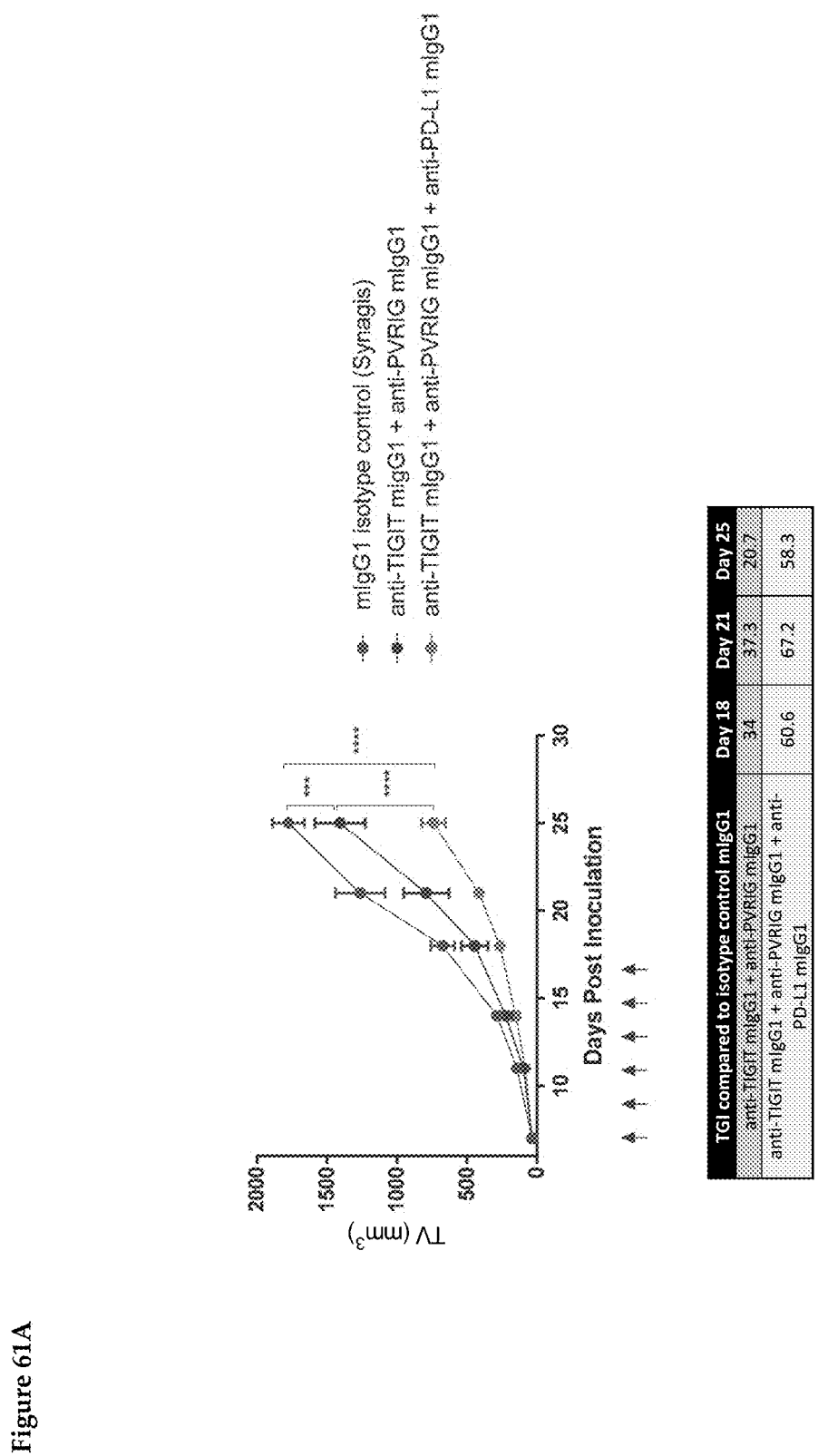
Figure 61B:
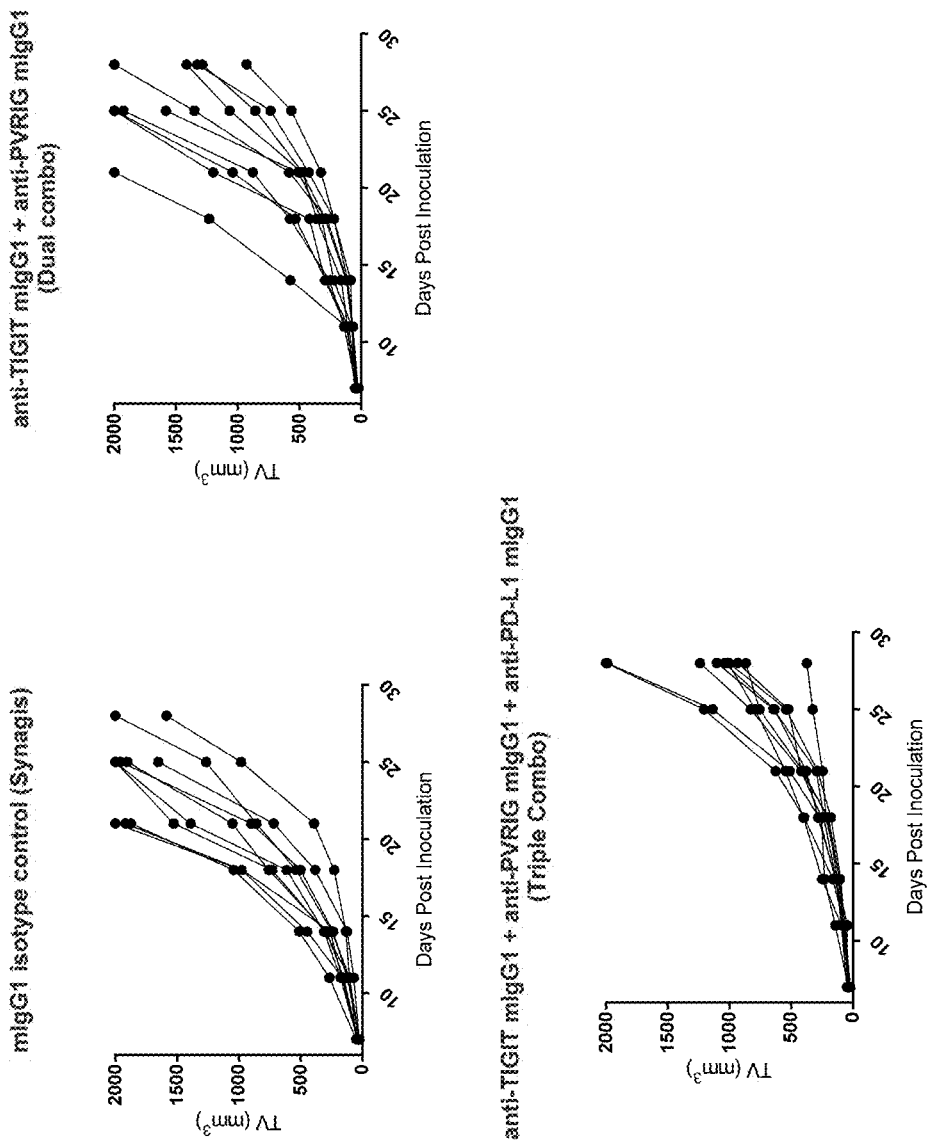
Figure 61C:
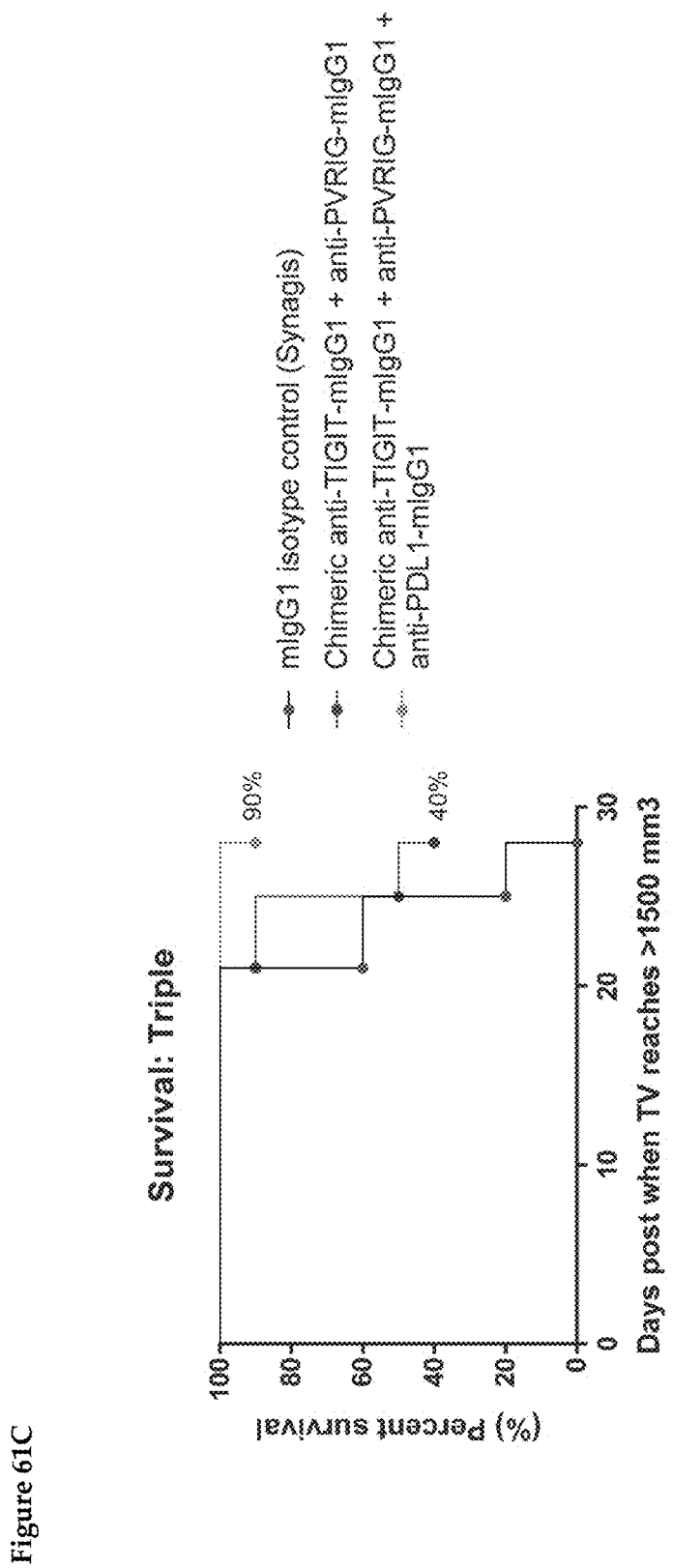

FIG. 61A-61C. TRIPLE COMBINATION SHOWED IMPROVED ANTITUMOR EFFICACY. A) Growth kinetics of CT26 tumors in a minimal disease model. Groups of 10 female Balb/c were inoculated with CT26 cells in the right flank. I.p. antibody administration began when tumors reached a desired mean volume (30-60 mm$^3$). Mice were treated with anti-TIGIT mIgG1 or anti-PVRIG mIgG1 at 10 mg/kg, anti-PD-L1 mIgG1 at 3 mg/kg, and control isotype at 10 mg/kg either as dual or triple combination, 3 times biweekly for a total of 6 doses. TGI with anti-TIGIT mIgG1 in combination was calculated by % TGI=[1−(average tumor volume of test article divided by average tumor volume of control article)*100]. The asterisk (*, **) indicate p<0.001 or p<0.0001, respectively, for differences between dual or triple combination over isotype control, versus dual or triple combination group by 2-way ANOVA. B) Spider plots of individual tumor volumes of each mouse in the three treatment groups were measured until tumor volumes of >1500 mm$^3$ or 45 days (study endpoints) were reached. C) Kaplan-Meier survival curves of mice treated in the three different treatment groups. A log-rank (Mantel-Cox) test revealed a p-value<0.0001, a 90% survival in mice treated triple antibody combination versus 40% survival in mice in dual antibody combination treatment.

FIG. 62A-62I depicts the sequences of exemplary anti-PD-L1 antibodies.

FIG. 63A-63AAAA depicts the sequences of numerous exemplary PVRIG antibodies.

IV. DETAILED DESCRIPTION OF THE INVENTION

A. Introduction

Therapeutic antibodies directed against immune checkpoint inhibitors such as PD-1 are showing great promise in limited circumstances in the clinic for the treatment of cancer. Cancer can be considered as an inability of the patient to recognize and eliminate cancerous cells. In many instances, these transformed (e.g. cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells-especially T cells-to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy®, Keytruda® and Opdivo®. These antibodies are generally referred to as "checkpoint inhibitors" because they block normally negative regulators of T cell immunity. It is generally understood that a variety of immunomodulatory signals, both costimulatory and coinhibitory, can be used to orchestrate an optimal antigen-specific immune response.

Generally, these monoclonal antibodies bind to checkpoint inhibitor proteins such as CTLA-4 and PD-1, which under normal circumstances prevent or suppress activation of cytotoxic T cells (CTLs). By inhibiting the checkpoint protein, for example through the use of antibodies that bind these proteins, an increased T cell response against tumors can be achieved. That is, these cancer checkpoint proteins suppress the immune response; when the proteins are blocked, for example using antibodies to the checkpoint protein, the immune system is activated, leading to immune stimulation, resulting in treatment of conditions such as cancer and infectious disease.

The present invention is directed to compositions and methods of using several anti-checkpoint inhibitors in combination, so as to result in better patient outcomes. In particular, combinations of anti-TIGIT, anti-PVRIG and anti-PD-1 antibodies are contemplated. Furthermore, these methods are particularly useful in combination with an evaluation of PD-L1 expression levels from the patient tumor. If the percentage of PD-L1 positive tumor cells or immune cells is greater than 1% (>1%) compared to the same tumor cells stained with antibody relevant isotype control antibody for the antibodies used then a triple combination of anti-TIGIT, anti-PVRIG and anti-PD-1 antibodies should be administered. Whereas, patients with a frequency of PD-L1 positive tumor cells or immune cells below 1% (<1%) compared to the isotype control should be administered a double combination of anti-TIGIT and anti-PVRIG antibodies.

As discussed herein, TIGIT is a co-inhibitory receptor that is highly expressed on effector & regulatory (Treg) CD4+ T cells, effector CD8+ T cells, and NK cells. TIGIT has been shown to attenuate immune response by (1) direct signaling, (2) inducing ligand signaling, and (3) competition with and disruption of signaling by the costimulatory receptor CD226 (also known as DNAM-1).

Human Poliovirus Receptor Related Immunoglobulin Domain Containing Protein, or "PVRIG", is expressed on the cell surface of NK and T-cells and shares several similarities to other known immune checkpoints. PVRIG has been validated as a checkpoint inhibitor, see U.S. Ser. Nos. 62/118,208, 62/141,120, 62/235,823, 62/376,334, 15/048,967, 62/376,335, 62/417,217 and 62/477,974, all of which are expressly incorporated herein by reference in their entirety and in particular for the sequences of the antibodies, figures and figure legends therein. As shown in those documents, PVRL2 was identified/confirmed to be the counterpart of PVRIG. Antibodies that bind to PVRIG were generated, and then a subset of those were identified that both bind to PVRIG and block the interaction of PVRIG and PVLR2. When PVRIG is bound by its ligand (PVRL2), an inhibitory signal is elicited which acts to attenuate the immune response of NK and T-cells against a target cell (i.e. analogous to PD-1/PDL1). Blocking the binding of PVRL2 to PVRIG shuts-off this inhibitory signal of PVRIG and as a result modulates the immune response of NK and T-cells.

PD-1, or "programmed cell death protein 1", is a known checkpoint inhibitor. There are two approved anti-PD-1 antibodies, pembrolizumab (Keytruda®), cemiplimab (REGN2810), and nivolumab (Opdivo®) and many more in development (including, but not limited to, pidilizumab, BAP049 clones as listed in WO2015/112900 (the sequences of which are expressly incorporated herein by reference), antibody 317-4B6 as listed in WO2015/035606 (the sequence of which is expressly incorporated herein by reference), antibody APE2058 as listed in US2016/0075783 (the sequence of which is expressly incorporated herein by reference).

There are three approved anti-PD-L1 antibodies, atezolizumab (TECENTRIQ®), avelumab (BAVENCIO®), and durvalumab, as well as other anti-PD-L1 antibodies in development.

Functional effects of the combinations of these antibodies on NK and T-cells can be assessed in vitro (and in some cases in vivo, as described more fully below) by measuring changes in the following parameters: proliferation, cytokine release and cell-surface makers. Accordingly, functional effects of the anti-TIGIT antibodies on NK, effector T, and Treg cells can be assessed in vitro (and in some cases, in vivo, as described more fully below) by measuring changes in the following parameters: proliferation, cytokine release and cell-surface receptors. For NK cells, increases in cell proliferation, cytotoxicity (ability to kill target cells as measured by increases in CD107a, granzyme, and perforin expression, or by directly measuring target cells killing), cytokine production (e.g. IFN-γ and TNF), and cell surface receptor expression (e.g. CD25) is indicative of immune modulation, e.g. enhanced killing of cancer cells. For effector T and Treg-cells, increases in proliferation, increases in expression of cell surface receptors of activation (e.g. CD25, CD69, CD137, and PD-1), cytotoxicity (ability to kill target cells, as mentioned above), and cytokine production (e.g. IL-2, IL-4, IL-6, IFN-γ, TNF-α, IL-10, IL-17A) are indicative of immune modulation, e.g. enhanced killing of cancer cells. Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells.

In particular, any one of the assays shown in Example 1 can be used to measure T cell activation and/or suppression of T cell inhibition.

Thus, in some embodiments the invention provides the use of combination therapies of anti-TIGIT, anti-PVRIG and anti-PD-1 antibodies (or just anti-TIGIT and anti-PVRIG antibodies in some cases as outlined herein) to perform one or more of the following in a subject in need thereof: (a) upregulating pro-inflammatory cytokines; (b) increasing T-cell proliferation and/or expansion; (c) increasing interferon- or TNF-α production by T-cells; (d) increasing IL-2 secretion; (e) stimulating antibody responses; (f) inhibiting cancer cell growth; (g) promoting antigenic specific T cell immunity; (h) promoting CD4+ and/or CD8+ T cell activation; (i) alleviating Treg-mediated-cell suppression; (j) promoting NK cell activity; (k) promoting apoptosis or lysis of cancer cells; and/or (l) cytotoxic or cytostatic effect on cancer cells.

Accordingly, the present invention provides anti-TIGIT, anti-PVRIG and anti-PD-1 antibodies for use in combination therapies, and in conjunction with diagnostic assays measuring the levels of one or more of TIGIT, PVRIG and PD-1 expression, and/or measuring the levels of the ligands of TIGIT (e.g., PVR), PVRIG (PVRL2) and PD-1 (PD-L1).

B. Definitions

In order that the application may be more completely understood, several definitions are set forth below. Such definitions are meant to encompass grammatical equivalents.

By "ablation" herein is meant a decrease or removal of activity. In some embodiments, it is useful to remove activity from the constant domains of the antibodies. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. As shown in FIG. 1, one ablation variant in the IgG1 constant region is the N297A variant, which removes the native glycosylation site and significantly reduces the FcγRIIIa binding and thus reduces the antibody dependent cell-mediated cytotoxicity (ADCC).

By "antigen binding domain" or "ABD" herein is meant a set of six Complementary Determining Regions (CDRs) that, when present as part of a polypeptide sequence, specifically binds a target antigen as discussed herein. Thus, a "TIGIT antigen binding domain" binds TIGIT antigen (the sequence of which is shown in FIG. 2) as outlined herein. As is known in the art, these CDRs are generally present as a first set of variable heavy CDRs (vhCDRs or VHCDRs) and a second set of variable light CDRs (vlCDRs or VLCDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain).

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino add at a particular position in a parent polypeptide sequence with a different amino add. In particular, in some embodiments, the substitution is to an amino add that is not naturally occurring at the particular position, either not naturally occurring within the organism or in any organism. For example, the substitution N297A refers to a variant polypeptide, in this case an Fc variant, in which the asparagine at position 297 is replaced with alanine. For clarity, a protein which has been engineered to change the nucleic add coding sequence but not change the starting amino add (for example exchanging CGG (encoding arginine) to CGA (still encoding arginine) to increase host organism expression levels) is not an "amino acid substitution"; that is, despite the creation of a new gene encoding the same protein, if the protein has the same amino add at the particular position that it started with, it is not an amino add substitution.

By "amino acid insertion" or "insertion" as used herein is meant the addition of an amino add sequence at a particular position in a parent polypeptide sequence. For example, −233E or 233E designates an insertion of glutamic acid after position 233 and before position 234. Additionally, −233ADE or A233ADE designates an insertion of AlaAspGlu after position 233 and before position 234.

By "amino acid deletion" or "deletion" as used herein is meant the removal of an amino add sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides". The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, S241P or S228P is a hinge variant with the substitution proline at position 228 relative to the parent IgG4 hinge polypeptide, wherein the numbering S228P is according to the EU index and the S241P is the Kabat numbering. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124: 9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and noreleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody or antibody fragment.

By "Fv" or "Fv fragment" or "Fv region" as used herein is meant a polypeptide that comprises the VL and VH domains of a single antibody. As will be appreciated by those in the art, these generally are made up of two chains.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In general, the linker is a scFv linker as is generally known in the art, with the linker peptide predominantly including the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 1851), (GGGGS)n (SEQ ID NO: 1852), and (GGGS)n (SEQ ID NO: 1853), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification. Similarly, because IgG1 has a proline at position 241 and IgG4 has a serine there, an IgG4 molecule with a S241P is considered an IgG subclass modification. Note that subclass modifications are considered amino acid substitutions herein.

By "non-naturally occurring modification" as used herein is meant an amino acid modification that is not isotypic. For example, because none of the IgGs comprise an asparagine at position 297, the substitution N297A in IgG1, IgG2, IgG3, or IgG4 (or hybrids thereof) is considered a non-naturally occurring modification.

By "amino acid" and "amino add identity" as used herein is meant one of the 20 naturally occurring amino adds that are coded for by DNA and RNA.

By "effector function" as used herein is meant a biochemical event that results from the interaction of an antibody Fc region with an Fc receptor or ligand. Effector functions include but are not limited to ADCC, ADCP, and CDC. In many cases, it is desirable to ablate most or all effector functions using either different IgG isotypes (e.g. IgG4) or amino add substitutions in the Fc domain; however, preserving binding to the FcRn receptor is desirable, as this contributes to the half-life of the antibodies in human serum.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino add sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "heavy constant region" herein is meant the CH1-hinge-CH2-CH3 portion of an antibody.

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. The target antigen of interest herein is TIGIT, usually human TIGIT and optionally cyno TIGIT, the sequences of which are shown in.

By "target cell" as used herein is meant a cell that expresses a target antigen.

By "variable region" as used herein is meant the region of an immunoglobulin that comprises one or more Ig domains substantially encoded by any of the $V_\kappa$ (V.kappa), Vλ (V.lamda), and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-9}$ M, at least about $10^{-10}$ M, at least about $10^{-11}$ M, at least about $10^{-12}$ M, at least about $10^{-13}$ M, at least about $10^{-14}$ M, at least about $10^{-15}$ M, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using surface plasmon resonance (e.g. Biacore assay) and flow cytometry with antigen-expressing cells.

V. ANTIBODIES

As is discussed below, the term "antibody" is used generally. Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g. vlCDR1, vlCDR2 and vlCDR3). A useful comparison of CDR numbering is as below, see Lafranc et al., Dev. Comp. Immunol. 27(1):55-77 (2003):

|        | Kabat + Clothia | IMGT    | Kabat  | AbM    | Chothia | Contact |
|--------|-----------------|---------|--------|--------|---------|---------|
| vhCDR1 | 26-35           | 27-38   | 31-35  | 26-35  | 26-32   | 30-35   |
| vhCDR2 | 50-65           | 56-65   | 50-65  | 50-58  | 53-55   | 47-58   |
| vhCDR3 | 95-102          | 105-117 | 95-102 | 95-102 | 96-101  | 93-101  |
| vlCDR1 | 24-34           | 27-38   | 24-34  | 24-34  | 26-32   | 30-36   |
| vlCDR2 | 50-56           | 56-65   | 50-56  | 50-56  | 50-52   | 46-55   |
| vlCDR3 | 89-97           | 105-117 | 89-97  | 89-97  | 91-96   | 89-96   |

Throughout the present specification, the Kabat numbering system is generally used when referring to a residue in the variable domain (approximately, residues 1-107 of the light chain variable region and residues 1-113 of the heavy chain variable region) and the hinge and the EU numbering system for Fc regions (e.g, Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used, or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230.

The light chain generally comprises two domains, the variable light domain (containing the light chain CDRs and together with the variable heavy domains forming the Fv region), and a constant light chain region (often referred to as CL or $C_\kappa$).

Another region of interest for additional substitutions, outlined below, is the Fc region.

A. Chimeric and Humanized Antibodies

In some embodiments, the antibodies herein can be derived from a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference.

In certain embodiments, the antibodies of the invention comprise a heavy chain variable region from a particular germline heavy chain immunoglobulin gene and/or a light chain variable region from a particular germline light chain immunoglobulin gene (with optional mutations as is generally described herein). For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene. In certain cases, the humanized antibody may display no more than 5, or even no more than 4, 3, 2, or 1 amino acid difference from the amino acid sequence encoded by the germline immunoglobulin gene (again, prior to the introduction of any variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

B. Specific anti-TIGIT antibodies

The invention provides antigen binding domains, including full length antibodies, which contain a number of specific, enumerated sets of 6 CDRs and defined variable heavy (vh, VH or $V_H$) and variable light (vl, VL or $V_L$), that bind to TIGIT.

In one embodiment, the anti-TIGIT antibody is an antibody comprising a set of six CDRs (vhCDR1, vhCDR2, vhCDR3, vlCDR1, vlCDR2 and vlCDR3) from CPA.9.083.H4(S241P) as depicted in FIG. 3. In one embodiment, the anti-TIGIT antibody is an antibody comprising the variable heavy (vh) and variable light (vl) domains from CPA.9.083.H4(S241P) as depicted in FIG. 3, linked to a human IgG constant domain of IgG1, IgG2, IgG3, IgG4 and IgG4(S241P). In one embodiment, the anti-TIGIT antibody is CPA.9.083.H4(S241P).

In one embodiment, the anti-TIGIT antibody is an antibody comprising a set of six CDRs (vhCDR1, vhCDR2, vhCDR3, vlCDR1, vlCDR2 and vlCDR3) from CPA.9.086.H4(S241P) as depicted in FIG. 3. In one embodiment, the anti-TIGIT antibody is an antibody comprising the variable heavy (vh) and variable light (vl) domains from CPA.9.086.H4(S241P) as depicted in FIG. 3, linked to a human IgG constant domain of IgG1, IgG2, IgG3, IgG4 and IgG4(S241P). In one embodiment, the anti-TIGIT antibody is CPA.9.086.H4(S241P).

In one embodiment, the anti-TIGIT antibody is an antibody comprising a set of six CDRs (vhCDR1, vhCDR2, vhCDR3, vlCDR1, vlCDR2 and vlCDR3) from CHA.9.547.7.H4(S241P) as depicted in FIG. 3. In one embodiment, the anti-TIGIT antibody is an antibody comprising the variable heavy (vh) and variable light (vl) domains from CHA.9.547.7.H4(S241P) as depicted in FIG. 3, linked to a human IgG constant domain of IgG1, IgG2, IgG3, IgG4 and IgG4(S241P). In one embodiment, the anti-TIGIT antibody is CHA.9.547.7.H4(S241P).

In one embodiment, the anti-TIGIT antibody is an antibody comprising a set of six CDRs (vhCDR1, vhCDR2, vhCDR3, vlCDR1, vlCDR2 and vlCDR3) from CHA.9.547.13.H4(S241P) as depicted in FIG. 3. In one embodiment, the anti-TIGIT antibody is an antibody comprising the variable heavy (vh) and variable light (vl) domains from CHA.9.547.13.H4(S241P) as depicted in FIG. 3, linked to a human IgG constant domain of IgG1, IgG2, IgG3, IgG4 and IgG4(S241P). In one embodiment, the anti-TIGIT antibody is CHA.9.547.13.H4(S241P).

Further anti-TIGIT antibodies that find use in combinations with anti-PVRIG antibodies as outlined herein are those in FIG. 4 of U.S. Ser. No. 62/513,916, entitled "Anti-TIGIT Antibodies and Methods of Use", filed on Jun. 1, 2017, by assignee Compugen, as well as those included in FIG. 3.

C. Additional Anti-TIGIT Antibodies for Use in Combination Therapy

Additional anti-TIGIT antibodies that can be used in combination with anti-PVRIG antibodies and optionally anti-PD-1 antibodies as outlined herein are also included. As discussed more fully below, anti-TIGIT antibodies show particular efficacy in combination with anti-PVRIG antibodies. Thus, in some embodiments, alternative anti-TIGIT antibodies are used in combination with anti-PVRIG antibodies outlined herein, and in particular either of CHA.7.538.1.2.H4(S241P) or CHA.7.518.1.H4(S241P).

Accordingly, in one embodiment, anti-TIGIT antibodies as outlined in U.S. Pat. No. 9,499,596, (hereby incorporated by reference in its entirety and specifically for the SEQ ID NO:s listed below) can be combined with CHA.7.538.1.2.H4(S241P) or CHA.7.518.1.H4(S241P). Specifically, an anti-TIGIT antibody having a light chain sequence of SEQ ID NO:21 and a heavy chain sequence of SEQ ID NO:22 (from U.S. Pat. No. 9,499,596) can be combined with CHA.7.538.1.2.H4(S241P) or CHA.7.518.1.H4(S241P). Additionally, an anti-TIGIT antibody having a light chain sequence of SEQ ID NO:29 and a heavy chain sequence of SEQ ID NO:30 (from U.S. Pat. No. 9,499,596) can be combined with CHA.7.538.1.2.H4(S241P) or CHA.7.518.1.H4(S241P).

Similarly, in one embodiment, anti-TIGIT antibodies as outlined in WO 2016/191643 (hereby incorporated by reference in its entirety and specifically for the SEQ ID NO:s listed below, and in particular for the sequences of the OMP-313M32 antibody) can be combined with CHA.7.538.1.2.H4(S241P) or CHA.7.518.1.H4(S241P). Specifically, an anti-TIGIT antibody having a light chain sequence of SEQ ID NO:72 and a heavy chain sequence of SEQ ID NO:70 (from WO 2016/191643) can be combined with CHA.7.538.1.2.H4(S241P) or CHA.7.518.1.H4(S241P).

Accordingly, in one embodiment, anti-TIGIT antibodies as outlined in WO 2017/053748 (hereby incorporated by reference in its entirety and specifically for the SEQ ID NO:s listed below) can be combined with CHA.7.538.1.2.H4(S241P) or CHA.7.518.1.H4(S241P). Specifically, an anti-TIGIT antibody having a variable light chain sequence of SEQ ID NO:36 and a variable heavy chain sequence of SEQ ID NO:34 (from WO 2017/053748) can be combined with CHA.7.538.1.2.H4(S241P) or CHA.7.518.1.H4(S241P). Additionally, an anti-TIGIT antibody having a variable light chain sequence of SEQ ID NO:36 and a variable heavy chain sequence of SEQ ID NO:35 (from WO 2017/053748) can be combined with CHA.7.538.1.2.H4(S241P) or CHA.7.518.1.H4(S241P). Additionally, an anti-TIGIT antibody having a variable light chain sequence of SEQ ID NO:38 and a variable heavy chain sequence of SEQ ID NO:37 (from WO 2017/053748) can be combined with CHA.7.538.1.2.H4(S241P) or CHA.7.518.1.H4(S241P). Additionally, an anti-TIGIT antibody having a variable light chain sequence of SEQ ID NO:40 and a variable heavy chain sequence of SEQ ID NO:39 (from WO 2017/053748) can be combined with CHA.7.538.1.2.H4(S241P) or CHA.7.518.1.H4(S241P). In one embodiment, anti-TIGIT antibodies include the Genentech antibody, MTIG7192A, currently in clinical trials (see, the World Wide Web at clinicaltrials.gov/ct2/show/NCT2794571?term=MTIG7192A&rank=1). In one embodiment, an MTIG7192A anti-TIGIT antibody can be combined with CHA.7.538.1.2.H4(S241P) or CHA.7.518.1.H4(S241P).

Similarly, in one embodiment, anti-TIGIT antibodies as outlined in WO2016/191643 (hereby incorporated by reference in its entirety and specifically for the SEQ ID NO:s listed below, and in particular for the sequences of the OMP-313M32 antibody can be combined with CHA.7.538.1.2.H4(S241P) or CHA.7.518.1.H4(S241P). Specifically, an anti-TIGIT antibody having a light chain sequence of SEQ ID NO:72 and a heavy chain sequence of SEQ ID NO:70 (from WO2016/191643) can be combined with CHA.7.538.1.2.H4(S241P) or CHA.7.518.1.H4(S241P). In one embodiment, anti-TIGIT antibodies include the Oncomed antibody, OMP-313M32, currently in clinical trials (see, the World Wide Web at clinicaltrials.gov/ct2/show/NCT03119428?term=OMP-313M32&rank=1). In one embodiment, an OMP-313M32 anti-TIGIT antibody can be combined with CHA.7.538.1.2.H4(S241P) or CHA.7.518.1.H4(S241P).

Additionally, in one embodiment, anti-TIGIT antibodies as outlined in WO 2016/028656 (hereby incorporated by reference in its entirety and specifically for the SEQ ID NO:s listed below, and in particular for the sequences of the MEB125.31C6.A1.205 VH4/VL1 (VH of SEQ ID NO:127, VL of SEQ ID NO:130 with a human IgG1 constant domain), MEB 125.31C6.A1.205 VH5/VL4 (VH of SEQ ID NO:128, VL of SEQ ID NO:133 and a human IgG1 constant region) and MEB125.31.C6,A1.205 VH5/VL3 (VH of SEQ ID NO:128, VL of SEQ ID NO:132 and a human IgG1 constant region) antibodies) can be combined with CHA.7.538.1.2.H4(S241P) or CHA.7.518.1.H4(S241P). Specifically, an anti-TIGIT antibody MEB125.31C6.A1.205 VH4/VL1 (VH of SEQ ID NO:127, VL of SEQ ID NO:130 with a human IgG1 constant domain) (from WO 2016/028656) can be combined with CHA.7.538.1.2.H4(S241P) or CHA.7.518.1.H4(S241P). Specifically, an anti-TIGIT antibody MEB125.31C6.A1.205 VH5/VL4 (VH of SEQ ID NO:128, VL of SEQ ID NO:133 and a human IgG1 constant region (from WO 2016/028656) can be combined with CHA.7.538.1.2.H4(S241P) or CHA.7.518.1.H4(S241P). Specifically, an anti-TIGIT antibody MEB125.31.C6.A1.205 VH5/VL3 (VH of SEQ ID NO:128, VL of SEQ ID NO:132 and a human IgG1 constant region) (from WO2016/028656) can be combined with CHA.7.538.1.2.H4(S241P) or CHA.7.518.1.H4(S241P). Specifically, an anti-TIGIT antibody comprising the VH of SEQ ID NO:7, VL of SEQ ID NO:8 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:63, VL of SEQ ID NO:64 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:94, VL of SEQ ID NO:95 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:126, VL of SEQ ID NO:131 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:128, VL of SEQ ID NO:131 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:125, VL of SEQ ID NO:133 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:126, VL of SEQ ID NO:130 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:125, VL of SEQ ID NO:132 and a human IgG1 constant region (from WO 2016/028656) can be combined with CHA.7.538.1.2.H4(S241P) or CHA.7.518.1.H4(S241P). Specifically, an anti- TIGIT antibody comprising the VH of SEQ ID NO:143, VL of SEQ ID NO:145 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:144, VL of SEQ ID NO:146 and a human IgG1 constant region (from WO 2016/028656) can be combined with CHA.7.538.1.2.H4(S241P) or CHA.7.518.1.H4 (S241P). Specifically, an anti-TIGIT antibody comprising the VH of SEQ ID NO:149, VL of SEQ ID NO:151 and a human IgG1 constant region (from WO 2016/028656) can be combined with CHA.7.538.1.2.H4(S241P) or CHA.7.518.1.H4(S241P). Specifically, an anti-TIGIT antibody comprising the VH of SEQ ID NO:150, VL of SEQ ID NO:152 and a human IgG1 constant region (from WO 2016/028656) can be combined with CHA.7.538.1.2.H4 (S241P) or CHA.7.518.1.H4(S241P).

Additionally, in one embodiment, anti-TIGIT antibodies as outlined in WO 2017/030823 hereby incorporated by reference in its entirety and specifically for the SEQ ID NO:s listed below) can be combined with CHA.7.538.1.2.H4 (S241P) or CHA.7.518.1.H4(S241P). Specifically, an anti-TIGIT antibody having a variable light chain sequence of SEQ ID NO:8 and a variable heavy chain sequence of SEQ ID NO:7 (from WO 2017/030823) can be combined with CHA.7.538.1.2.H4(S241P) or CHA.7.518.1.H4(S241P). Specifically, an anti-TIGIT antibody having a variable light chain sequence of SEQ ID NO:13 and a variable heavy chain sequence of SEQ ID NO:9 (from WO 2017/030823) can be combined with CHA.7.538.1.2.H4(S241P) or CHA.7.518.1.H4(S241P). Specifically, an anti-TIGIT antibody having a variable light chain sequence of SEQ ID NO:24 and a variable heavy chain sequence of SEQ ID NO:23 (from WO 2017/030823) can be combined with CHA.7.538.1.2.H4(S241P) or CHA.7.518.1.H4(S241P). Specifically, an anti-TIGIT antibody having a variable light chain sequence of SEQ ID NO:29 and a variable heavy chain sequence of SEQ ID NO:25 (from WO 2017/030823) can be combined with CHA.7.538.1.2.H4(S241P) or CHA.7.518.1.H4(S241P). In some embodiments, an anti-TIGIT antibody having a variable light chain selected from sequences of SEQ ID NO:s 14, 15, 16, 63, 64, 65, 66, 67, 68, 69, 70, 71, 72, 73, 74, 75, 76, 77, 78, 79, or 80 and a variable heavy chain sequence of SEQ ID NO:s 10, 11, 12, 48, 49, 50, 51, 52, 53, 54, 55, or 56 (from WO 2017/030823) can be combined with CHA.7.538.1.2.H4(S241P) or CHA.7.518.1.H4(S241P). In some embodiments, an anti-TIGIT antibody having a variable light chain selected from sequences of SEQ ID NO:s 14, 15, 16, 63, 64, 65, 66, 67, 68, 69, 70, 71, 72, 73, 74, 75, 76, 77, 78, 79, or 80 and a variable heavy chain sequence of SEQ ID NO:s 10, 11, 12, 48, 49, 50, 51, 52, 53, 54, 55, or 56 (from WO2017/030823) can be combined with CHA.7.538.1.2.H4(S241P) or CHA.7.518.1.H4(S241P). In some embodiments, an anti-TIGIT antibody having a variable light chain selected from sequences of SEQ ID NO:s 30, 31, or 32 and a variable heavy chain sequence of SEQ ID NO: 26, 27, 28, 89, 90, 91, 92, 93, 94, 95, 96, 97, 98, 99, 100, 101, 102, 103, 104, 105, 106, 107, 108, 109, 110, 111, or 112 (from WO2017/030823) can be combined with CHA.7.538.1.2.H4(S241P) or CHA.7.518.1.H4(S241P). In one embodiment, anti-TIGIT antibodies include the Merck antibody, MK-7684, currently in clinical trials (see, the World Wide Web at clinicaltrials.gov/ct2/show/NCT02964013?term=MK-7684&rank=1). In one embodiment, an MK-7684 anti-TIGIT antibody can be combined with CHA.7.538.1.2.H4 (S241P) or CHA.7.518.1.H4(S241P).

Accordingly, in one embodiment, anti-TIGIT antibodies as outlined in US Patent Appl. No. 2016/0176963 (hereby incorporated by reference in its entirety and specifically for the SEQ ID NO:s listed below) can be combined with CHA.7.538.1.2.H4(S241P) or CHA.7.518.1.H4(S241P). Specifically, an anti-TIGIT antibody having a variable light chain sequence of SEQ ID NO:s 6, 9, 11, or 13 and a variable heavy chain sequence of SEQ ID NO:s 2, 3, 4, 5, 7, 8, 10, or 12 (from US2016/0176963) can be combined with CHA.7.538.1.2.H4(S241P) or CHA.7.518.1.H4(S241P). Specifically, an anti-TIGIT antibody having a variable light chain sequence of SEQ ID NO:s 6 and a variable heavy chain sequence of SEQ ID NO:s 2, 3, 4, or 5 (from US2016/0176963) can be combined with CHA.7.538.1.2.H4(S241P) or CHA.7.518.1.H4(S241P). Specifically, an anti-TIGIT antibody having a variable light chain sequence of SEQ ID NO:s 9 and a variable heavy chain sequence of SEQ ID NO:s 7 or 8 (from US2016/ 0176963) can be combined with CHA.7.538.1.2.H4(S241P) or CHA.7.518.1.H4(S241P). Specifically, an anti-TIGIT antibody having a variable light chain sequence of SEQ ID NO: 11 and a variable heavy chain sequence of SEQ ID NO: 10 (from US2016/0176963) can be combined with CHA.7.538.1.2.H4(S241P) or CHA.7.518.1.H4(S241P). Specifically, an anti-TIGIT antibody having a variable light chain sequence of SEQ ID NO: 13 and a variable heavy chain sequence of SEQ ID NO: 12 (from US2016/0176963) can be combined with CHA.7.538.1.2.H4(S241P) or CHA.7.518.1.H4(S241P). In one embodiment, anti-TIGIT antibodies include the BMS antibody, BMS-98620, currently in clinical trials (see, the World Wide Web at clinicaltrials.gov/ct2/show/NCT02913313?term=BMS-986207&rank=1). In one embodiment, an BMS-98620 anti-TIGIT antibody can be combined with CHA.7.538.1.2.H4 (S241P) or CHA.7.518.1.H4(S241P).

In one embodiment, anti-TIGIT antibodies include the Arcus Bio antibody, AB154. In one embodiment, an AB154 anti-TIGIT antibody can be combined with CHA.7.538.1.2.H4(S241P) or CHA.7.518.1.H4(S241P).

Additionally, in one embodiment, anti-TIGIT antibodies as outlined in WO 2017/037707 (hereby incorporated by reference in its entirety and specifically for the SEQ ID NO:s listed below, and in particular for the sequences of the SEQ ID NO:s listed below, and in particular for the VSIG9#1 antibody (SEQ ID NO:7 VH and SEQ ID NO: 8 VL) and the 258-cs1#4 antibody (SEQ ID NO:18 VH and SEQ ID NO: 19 VL). Specifically, the anti-TIGIT antibody VSIG9#1 antibody (from WO2017/037707; SEQ ID NO:7 VH and SEQ ID NO: 8 VL) can be combined with CHA.7.538.1.2.H4(S241P) or CHA.7.518.1.H4(S241P). Specifically, the anti-TIGIT antibody 258-cs1#4 (from WO2017/037707; SEQ ID NO:18 VH and SEQ ID NO: 19 VL) can be combined with CHA.7.538.1.2.H4(S241P) or CHA.7.518.1.H4(S241P).

Additionally, in one embodiment, anti-TIGIT antibodies as outlined in WO 2017/059095 (hereby incorporated by reference in its entirety and specifically for the SEQ ID NO:s listed below, and in particular for the sequences disclosed therein. Specifically, the anti-TIGIT antibody comprising a $V_H$ sequence of SEQ ID NO: 13 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a $V_H$ sequence of SEQ ID NO: 12 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a $V_H$ sequence of SEQ ID NO: 14 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a $V_H$ sequence of SEQ ID NO: 15 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a $V_H$ sequence of SEQ ID NO: 9 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a $V_H$ sequence of SEQ ID NO: 10 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a $V_H$ sequence of SEQ ID NO: 11 and a $V_L$ sequence of SEQ ID NO: 26 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 99 and a light chain of SEQ ID NO: 92; or (it) a heavy chain of SEQ ID NO: 100 and a light chain of SEQ ID NO: 92 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 97 and a light chain of SEQ ID NO: 92; or (ii) a heavy chain of SEQ ID NO: 98 and a light chain of SEQ ID NO: 92 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 101 and a light chain of SEQ ID NO: 92; or (ii) a heavy chain of SEQ ID NO: 102 and a light chain of SEQ ID NO: 92 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 103 and a light chain of SEQ ID NO: 92; or (ii) a heavy chain of SEQ ID NO: 104 and a light chain of SEQ ID NO: 92 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 90 and a light chain of SEQ ID NO: 92; or (ii) a heavy chain of SEQ ID NO: 91 and a light chain of SEQ ID NO: 92 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 93 and a light chain of SEQ ID NO: 92; or (ii) a heavy chain of SEQ ID NO: 94 and a light chain of SEQ ID NO: 92 (from WO 2017/059095) can be combined with CHA.7.538.1.2.H4(S241P) or CHA.7.518.1.H4(S241P). Specifically, the anti-TIGIT antibody comprising a heavy chain of SEQ ID NO: 95 and a light chain of SEQ ID NO: 92; or (ii) a heavy chain of SEQ ID NO: 96 and a light chain of SEQ ID NO: 92 (from WO 2017/059095) can be combined with CHA.7.538.1.2.H4(S241P) or CHA.7.518.1.H4 (S241P). Additionally, in one embodiment, anti-TIGIT antibodies as outlined in WO 2016/106302 (hereby incorporated by reference in its entirety and specifically for the SEQ ID NO:s listed below, and in particular for the sequences of the particular sequences disclosed therein. Specifically, the anti-TIGIT antibody comprising a heavy chain sequence selected from SEQ ID NOs: 2, 3, 4, 5, 7, 8, 10 or 12 (from WO 2016/106302) and a light chain sequence from SEQ ID NOs: 6, 9, 11, or 13 (from WO 2016/106302) can be combined with CHA.7.538.1.2.H4(S241P) or CHA.7.518.1.H4 (S241P). Specifically, the anti-TIGIT antibody 22G2 (from WO 2016/106302) can be combined with CHA.7.538.1.2.H4(S241P) or CHA.7.518.1.H4(S241P). Specifically, the anti-TIGIT antibody 11G11 (from WO 2016/106302) can be combined with CHA.7.538.1.2.H4 (S241P) or CHA.7.518.1.H4(S241P). Specifically, the anti-TIGIT antibody 15A6 (from WO 2016/106302) can be combined with CHA.7.538.1.2.H4(S241P) or CHA.7.518.1.H4(S241P).

Additionally, in one embodiment, anti-TIGIT antibodies as outlined in U.S. Patent Publication No. 2017281764 (hereby incorporated by reference in its entirety and specifically for the SEQ ID NO:s listed below, and in particular for the sequences disclosed therein. Specifically, the anti-TIGIT antibody comprising a $V_H$ sequence of SEQ ID NO: 10 and a $V_L$ sequence of SEQ ID NO: 14 (from US 2017281764) can be combined with CHA.7.538.1.2.H4 (S241P) or CHA.7.518.1.H4(S241P). Specifically, the anti-TIGIT antibody comprising a $V_H$ sequence of SEQ ID NO: 18 and a $V_L$ sequence of SEQ ID NO: 22 (from US 2017281764) can be combined with CHA.7.538.1.2.H4 (S241P) or CHA.7.518.1.H4(S241P). Specifically, the anti-TIGIT antibody comprising a $V_H$ sequence of SEQ ID NO: 26 and a $V_L$ sequence of SEQ ID NO: 30 (from US 2017281764) can be combined with CHA.7.538.1.2.H4 (S241P) or CHA.7.518.1.H4(S241P). Specifically, the anti-TIGIT antibody comprising a $V_H$ sequence of SEQ ID NO: 35 and a $V_L$ sequence of SEQ ID NO: 37 (from US 2017281764) can be combined with CHA.7.538.1.2.H4 (S241P) or CHA.7.518.1.H4(S241P). Specifically, the anti-TIGIT antibody comprising a $V_H$ sequence of SEQ ID NO: 34 and a $V_L$ sequence of SEQ ID NO: 36 (from US 2017281764) can be combined with CHA.7.538.1.2.H4 (S241P) or CHA.7.518.1.H4(S241P).

In another embodiment, anti-TIGIT antibodies as outlined in International Patent Publication No. WO 2015/009856 (hereby incorporated by reference in its entirety and specifically for the SEQ ID NO:s listed below, and in particular for the sequences disclosed therein (see, also International Patent Publication No. WO 2016/011264). Specifically, the anti-TIGIT antibody comprising a $V_H$ sequence of SEQ ID NO: 15 and a $V_L$ sequence of SEQ ID NO: 13 (from WO 2015/009856) can be combined with CHA.7.538.1.2.H4 (S241P) or CHA.7.518.1.H4(S241P). Specifically, the anti-TIGIT antibody comprising a $V_H$ sequence of SEQ ID NO: 16 and a $V_L$ sequence of SEQ ID NO: 14 (from WO 2015/009856) can be combined with CHA.7.538.1.2.H4 (S241P) or CHA.7.518.1.H4(S241P).

In some embodiments, the anti-TIGIT antibody is an antibody described in any of U.S. Patent Application No. 20170037133, International Patent Publication No. WO 2017/048824, a MBSA43 (commercially available from eBioscience), is anti-TIGIT antibody pab2197 or pab2196 (U.S. Patent Application No. 2017/0081409), EOS084448, CASC-674 (available from Adimab LLC). Specifically, an anti-TIGIT antibody as described in U.S. Patent Application No. 2017/0037133 can be combined with CHA.7.538.1.2.H4(S241P) or CHA.7.518.1.H4(S241P). Specifically, an anti-TIGIT antibody as described in International Patent Publication No. WO 2017/048824 can be combined with CHA.7.538.1.2.H4(S241P) or CHA.7.518.1.H4(S241P). Specifically, the anti-TIGIT antibody MBSA43 can be combined with CHA.7.538.1.2.H4 (S241P) or CHA.7.518.1.H4(S241P). Specifically, the anti-TIGIT antibody pab2197 can be combined with CHA.7.538.1.2.H4(S241P) or CHA.7.518.1.H4(S241P). Specifically, the anti-TIGIT antibody pab2196 can be combined with CHA.7.538.1.2.H4(S241P) or CHA.7.518.1.H4

(S241P). Specifically, the anti-TIGIT antibody EOS084448 can be combined with CHA.7.538.1.2.H4(S241P) or CHA.7.518.1.H4(S241P). Specifically, the anti-TIGIT antibody CASC-674 can be combined with CHA.7.538.1.2.H4 (S241P) or CHA.7.518.1.H4(S241P).

In some embodiments, the anti-TIGIT antibody is an antibody described in U.S. Pat. No. 9,713,364 (incorporated herein by reference in its entirety). In some embodiments, the anti-TIGIT antibody is PTZ-201 (ASP8374). Specifically, the anti-TIGIT antibody PTZ-201 (ASP8374) can be combined with CHA.7.538.1.2.H4(S241P) or CHA.7.518.1.H4(S241P). In some embodiments, the anti-TIGIT antibody is an antibody selected from the group consisting of MAB1, MAB2, MAB3, MAB4, MAB5, MAB6, MAB7, MAB8, MAB9, MAB10, MAB11, MAB12, MAB13, MAB14, MAB15, MAB6, MAB17, MAB18, 40 MAB19, MAB20, or MAB21, as described in U.S. Pat. No. 9,713,364. Specifically, the anti-TIGIT antibody MAB1 from U.S. Pat. No. 9,713,364 can be combined with CHA.7.538.1.2.H4(S241P) or CHA.7.518.1.H4(S241P). Specifically, the anti-TIGIT antibody MAB2 from U.S. Pat. No. 9,713,364 can be combined with CHA.7.538.1.2.H4 (S241P) or CHA.7.518.1.H4(S241P). Specifically, the anti-TIGIT antibody MAB3 from U.S. Pat. No. 9,713,364 can be combined with CHA.7.538.1.2.H4(S241P) or CHA.7.518.1.H4(S241P). Specifically, the anti-TIGIT antibody MAB4 from U.S. Pat. No. 9,713,364 can be combined with CHA.7.538.1.2.H4(S241P) or CHA.7.518.1.H4 (S241P). Specifically, the anti-TIGIT antibody MAB5 from U.S. Pat. No. 9,713,364 can be combined with CHA.7.538.1.2.H4(S241P) or CHA.7.518.1.H4(S241P). Specifically, the anti-TIGIT antibody MAB6 from U.S. Pat. No. 9,713,364 can be combined with CHA.7.538.1.2.H4 (S241P) or CHA.7.518.1.H4(S241P). Specifically, the anti-TIGIT antibody MAB7 from U.S. Pat. No. 9,713,364 can be combined with CHA.7.538.1.2.H4(S241P) or CHA.7.518.1.H4(S241P). Specifically, the anti-TIGIT antibody MAB8 from U.S. Pat. No. 9,713,364 can be combined with CHA.7.538.1.2.H4(S241P) or CHA.7.518.1.H4 (S241P). Specifically, the anti-TIGIT antibody MAB9 from U.S. Pat. No. 9,713,364 can be combined with CHA.7.538.1.2.H4(S241P) or CHA.7.518.1.H4(S241P). Specifically, the anti-TIGIT antibody MAB10 from U.S. Pat. No. 9,713,364 can be combined with CHA.7.538.1.2.H4 (S241P) or CHA.7.518.1.H4(S241P). Specifically, the anti-TIGIT antibody MAB11 from U.S. Pat. No. 9,713,364 can be combined with CHA.7.538.1.2.H4(S241P) or CHA.7.518.1.H4(S241P). Specifically, the anti-TIGIT antibody MAB12 from U.S. Pat. No. 9,713,364 can be combined with CHA.7.538.1.2.H4(S241P) or CHA.7.518.1.H4 (S241P). Specifically, the anti-TIGIT antibody MAB13 from U.S. Pat. No. 9,713,364 can be combined with CHA.7.538.1.2.H4(S241P) or CHA.7.518.1.H4(S241P). Specifically, the anti-TIGIT antibody MAB14 from U.S. Pat. No. 9,713,364 can be combined with CHA.7.538.1.2.H4 (S241P) or CHA.7.518.1.H4(S241P). Specifically, the anti-TIGIT antibody MAB15 from U.S. Pat. No. 9,713,364 can be combined with CHA.7.538.1.2.H4(S241P) or CHA.7.518.1.H4(S241P). Specifically, the anti-TIGIT antibody MAB16 from U.S. Pat. No. 9,713,364 can be combined with CHA.7.538.1.2.H4(S241P) or CHA.7.518.1.H4 (S241P). Specifically, the anti-TIGIT antibody MAB17 from U.S. Pat. No. 9,713,364 can be combined with CHA.7.538.1.2.H4(S241P) or CHA.7.518.1.H4(S241P). Specifically, the anti-TIGIT antibody MAB18 from U.S. Pat. No. 9,713,364 can be combined with CHA.7.538.1.2.H4 (S241P) or CHA.7.518.1.H4(S241P). Specifically, the anti-TIGIT antibody MAB19 from U.S. Pat. No. 9,713,364 can be combined with CHA.7.538.1.2.H4(S241P) or CHA.7.518.1.H4(S241P). Specifically, the anti-TIGIT antibody MAB20 from U.S. Pat. No. 9,713,364 can be combined with CHA.7.538.1.2.H4(S241P) or CHA.7.518.1.H4 (S241P). Specifically, the anti-TIGIT antibody MAB21 from U.S. Pat. No. 9,713,364 can be combined with CHA.7.538.1.2.H4(S241P) or CHA.7.518.1.H4(S241P).

In some embodiments, the anti-TIGIT antibody is 10A7, 1F4, 14A6, 28H5, 31C6, 15A6, 22G2, 11G11, and/or 10D7, the contents of each of which are incorporated herein by reference in their entirety. Specifically, the anti-TIGIT antibody 10A7 can be combined with CHA.7.538.1.2.H4 (S241P) or CHA.7.518.1.H4(S241P). Specifically, the anti-TIGIT antibody 1F4 can be combined with CHA.7.538.1.2.H4(S241P) or CHA.7.518.1.H4(S241P). Specifically, the anti-TIGIT antibody 14A6 can be combined with CHA.7.538.1.2.H4(S241P) or CHA.7.518.1.H4 (S241P). Specifically, the anti-TIGIT antibody 28H5 can be combined with CHA.7.538.1.2.H4(S241P) or CHA.7.518.1.H4(S241P). Specifically, the anti-TIGIT antibody 31C6 can be combined with CHA.7.538.1.2.H4 (S241P) or CHA.7.518.1.H4(S241P). Specifically, the anti-TIGIT antibody 15A6 can be combined with CHA.7.538.1.2.H4(S241P) or CHA.7.518.1.H4(S241P). Specifically, the anti-TIGIT antibody 22G2 can be combined with CHA.7.538.1.2.H4(S241P) or CHA.7.518.1.H4 (S241P). Specifically, the anti-TIGIT antibody 11G11 can be combined with CHA.7.538.1.2.H4(S241P) or CHA.7.518.1.H4(S241P). Specifically, the anti-TIGIT antibody 10D7 can be combined with CHA.7.538.1.2.H4 (S241P) or CHA.7.518.1.H4(S241P).

In some embodiments, the anti-TIGIT antibody is one of those described in International Patent Publication WO 2016/028656, incorporated herein in its entirety. Specifically, the anti-TIGIT antibodies are provided in International Patent Publication No. WO 2016/028656 (and reproduced herein in FIG. 3) can be combined with CHA.7.538.1.2.H4 (S241P) or CHA.7.518.1.H4(S241P).

The anti-TIGIT antibodies described herein can find use according to the triple combination therapy methods of the invention are labeled as follows. Such TIGIT antibodies have reference numbers, for example "CPA.9.086". This represents the combination of the variable heavy and variable light chains, as depicted in FIG. 3, for example, with the understanding that these antibodies include two heavy chains and two light chains. "CPA.9.086.VH" refers to the variable heavy portion of CPA. 9. 086, while "CPA. 9. 086.VL" is the variable light chain. "CPA. 9. 086.vhCDR1", "CPA. 9. 086.vhCDR2", "CPA. 9. 086.vhCDR3", "CPA. 9. 086.vlCDR1", "CPA. 9. 086.vlCDR2", and "CPA. 9. 086.vlCDR3", refers to the CDRs are indicated. "CPA. 9. 086.HC" refers to the entire heavy chain (e.g. variable and constant domain) of this molecule, and "CPA. 9. 086.LC" refers to the entire light chain (e.g. variable and constant domain) of the same molecule. In general, the human kappa light chain is used for the constant domain of each phage (or humanized hybridoma) antibody herein, although in some embodiments the lambda light constant domain is used. "CPA. 9. 086.H1" refers to a full length antibody comprising the variable heavy and light domains, including the constant domain of Human IgG1 (hence, the H1; IgG1, IgG2, IgG3 and IgG4 sequences are shown in FIG. 1, for example). Accordingly, "CPA. 9. 086.H2" would be the CPA. 9. 086 variable domains linked to a Human IgG2. "CPA. 9. 086.H3" would be the CPA. 9. 086 variable domains linked to a Human IgG3, and "CPA. 9. 086.H4" would be the CPA.

9. 086 variable domains linked to a Human IgG4. Note that in some cases, the human IgGs may have additional mutations, such are described below, and this can be annotated. For example, in many embodiments, there may be a S241P mutation in the human IgG4, and this can be annotated as "CPA.9.086.H4(S241P)" for example. The human IgG4 sequence with this S241P hinge variant is shown in FIG. 1. Other potential variants are IgG1(N297A), (or other variants that ablate glycosylation at this site and thus many of the effector functions associated with FcγRIIIa binding), and IgG1(D265A), which reduces binding to FcγR receptors. The anti-TIGIT antibodies for use in the present invention can comprise any of the TIGIT antibody domain sequences. The anti-TIGIT antibodies for use in the present invention can comprise any of the TIGIT antigen binding domains.

The invention further provides variable heavy and light domains as well as full length heavy and light chains.

In some embodiments, the invention provides scFvs that bind to TIGIT comprising a variable heavy domain and a variable light domain linked by an scFv linker as outlined above. The VL and VH domains can be in either orientation, e.g. from N- to C-terminus "VH-linker-VL" or "VL-linker" VH". These are named by their component parts; for example, "scFv-CPA. 9.086.VH-linker-VL" or "scFv-CPA.9.086.VL-linker-VH." Thus, "scFv-CPA.9.086" can be in either orientation. The anti-TIGIT antibodies for use in the present invention can comprise any scFvs that bind to TIGIT. The anti-TIGIT antibodies for use in the present invention can comprise any scFvs that bind to TIGIT. The anti-TIGIT antibodies for use in the present invention can include any of the following:

CPA.9.018, CPA.9.018.VH, CPA.9.018.VL, CPA.9.018.HC, CPA.9.018.LC, CPA.9.018.H1, CPA.9.018.H2, CPA.9.018.H3, CPA.9.018.H4; CPA.9.018.H4(S241P); CPA.9.018.vhCDR1, CPA.9.018.vhCDR2, CPA.9.018.vhCDR3, CPA.9.018.vlCDR1, CPA.9.018.vlCDR2, CPA.9.018.vlCDR3 and scFv-CPA.9.018;

CPA.9.027, CPA.9.027.VH, CPA.9.027.VL, CPA.9.027.HC, CPA.9.027.LC, CPA.9.027.H1, CPA.9.027.H2, CPA.9.027.H3, CPA.9.027.H4; CPA.9.018.H4(S241P); CPA.9.027.vhCDR1, CPA.9.027.vhCDR2, CPA.9.027.vhCDR3, CPA.9.027.vlCDR1, CPA.9.027.vlCDR2, CPA.9.027.vlCDR3 and scFv-CPA.9.027;

CPA.9.049, CPA.9.049.VH, CPA.9.049.VL, CPA.9.049.HC, CPA.9.049.LC, CPA.9.049.H1, CPA.9.049.H2, CPA.9.049.H3; CPA.9.049.H4; CPA.9.049.H4(S241P); CPA.9.049.vhCDR1, CPA.9.049.vhCDR2, CPA.9.049.vhCDR3, CPA.9.049.vlCDR1, CPA.9.049.vlCDR2, CPA.9.049.vlCDR3 and scFv-CPA.9.049;

CPA.9.057, CPA.9.057.VH, CPA.9.057.VL, CPA.9.057.HC, CPA.9.057.LC, CPA.9.057.H1, CPA.9.057.H2, CPA.9.057.H3; CPA.9.057.H4; CPA.9.057.H4(S241P); CPA.9.057.vhCDR1, CPA.9.057.vhCDR2, CPA.9.057.vhCDR3, CPA.9.057.vlCDR1, CPA.9.057.vlCDR2, CPA.9.057.vlCDR3 and scFv-CPA.9.057;

CPA.9.059, CPA.9.059.VH, CPA.9.059.VL, CPA.9.059.HC, CPA.9.059.LC, CPA.9.059.H1, CPA.9.059.H2, CPA.9.059.H3; CPA.9.059.H4; CPA.9.059.H4(S241P); CPA.9.059.vhCDR1, CPA.9.059.vhCDR2, CPA.9.059.vhCDR3, CPA.9.059.vlCDR1, CPA.9.059.vlCDR2, CPA.9.059.vlCDR3 and scFv-CPA.9.059;

CPA.9.083, CPA.9.083.VH, CPA.9.083.VL, CPA.9.083.HC, CPA.9.083.LC, CPA.9.083.H1, CPA.9.083.H2, CPA.9.083.H3; CPA.9.083.H4; CPA.9.083.H4(S241P); CPA.9.083.vhCDR1, CPA.9.083.vhCDR2, CPA.9.083.vhCDR3, CPA.9.083.vlCDR1, CPA.9.083.vlCDR2, CPA.9.083.vlCDR3 and scFv-CPA.9.083;

CPA.9.086, CPA.9.086.VH, CPA.9.086.VL, CPA.9.086.HC, CPA.9.086.LC, CPA.9.086.H1, CPA.9.086.H2, CPA.9.086.H3; CPA.9.086.H4; CPA.9.086.H4(S241P); CPA.9.086.vhCDR1, CPA.9.086.vhCDR2, CPA.9.086.vhCDR3, CPA.9.086.vlCDR1, CPA.9.086.vlCDR2, CPA.9.086.vlCDR3 and scFv-CPA.9.086;

CPA.9.089, CPA.9.089.VH, CPA.9.089.VL, CPA.9.089.HC, CPA.9.089.LC, CPA.9.089.H1, CPA.9.089.H2, CPA.9.089.H3; CPA.9.089.H4; CPA.9.089.H4(S241P); CPA.9.089.vhCDR1, CPA.9.089.vhCDR2, CPA.9.089.vhCDR3, CPA.9.089.vlCDR1, CPA.9.089.vlCDR2, CPA.9.089.vlCDR3 and scFv-CPA.9.089;

CPA.9.093, CPA.9.093.VH, CPA.9.093.VL, CPA.9.093.HC, CPA.9.093.LC, CPA.9.093.H1, CPA.9.093.H2, CPA.9.093.H3; CPA.9.093.H4; CPA.9.093.H4(S241P); CPA.9.093.vhCDR1, CPA.9.093.vhCDR2, CPA.9.093.vhCDR3, CPA.9.093.vlCDR1, CPA.9.093.vlCDR2, CPA.9.093.vlCDR3 and scFv-CPA.9.093;

CPA.9.101, CPA.9.101.VH, CPA.9.101.VL, CPA.9.101.HC, CPA.9.101.LC, CPA.9.101.H1, CPA.9.101.H2, CPA.9.101.H3; CPA.9.101.H4; CPA.9.101.H4(S241P); CPA.9.101.vhCDR1, CPA.9.101.vhCDR2, CPA.9.101.vhCDR3, CPA.9.101.vlCDR1, CPA.9.101.vlCDR2, CPA.9.101.vlCDR3 and scFv-CPA.9.101; and CPA.9.103, CPA.9.103.VH, CPA.9.103.VL, CPA.9.103.HC, CPA.9.103.LC, CPA.9.103.H1, CPA.9.103.H2, CPA.9.103.H3; CPA.9.103.H4; CPA.9.103.H4(S241P); CPA.9.103.vhCDR1, CPA.9.103.vhCDR2, CPA.9.103.vhCDR3, CPA.9.103.vlCDR1, CPA.9.103.vlCDR2, CPA.9.103.vlCDR3 and scFv-CPA.9.103.

Furthermore, the present invention provides a number of CHA antibodies, which are murine antibodies generated from hybridomas. As is well known the art, the six CDRs are useful when put into either human framework variable heavy and variable light regions or when the variable heavy and light domains are humanized. Accordingly, the present invention provides antibodies, usually full length or scFv domains, that comprise the following sets of CDRs, the sequences of which are shown in FIG. 3 and/or the sequence listing:

CHA.9.536.1, CHA.9.536.1.VH, CHA.9.536.1.VL, CHA.9.536.1.HC, CHA.9.536.1.LC, CHA.9.536.1.H1, CHA.9.536.1.H2, CHA.9.536.1.H3; CHA.9.536.1.H4, CHA.9.536.1.H4(S241P), CHA.9.536.1.vhCDR1, CHA.9.536.1.vhCDR2, CHA.9.536.1.vhCDR3, CHA.9.536.1.vlCDR1, CHA.9.536.1.vlCDR2 and CHA.9.536.1.vhCDR3;

CHA.9.536.3, CHA.9.536.3.VH, CHA.9.536.3.VL, CHA.9.536.3.HC, CHA.9.536.3.LC, CHA.9.536.3.H1, CHA.9.536.3.H2, CHA.9.536.3.H3; CHA.9.536.3.H4, CHA.9.536.3.H4(S241P); CHA.9.536.3.vhCDR1, CHA.9.536.3.vhCDR2, CHA.9.536.3.vhCDR3, CHA.9.536.3.vlCDR1, CHA.9.536.3.vlCDR2 and CHA.9.536.3.vhCDR3;

CHA.9.536.4, CHA.9.536.4.VH, CHA.9.536.4.VL, CHA.9.536.4.HC, CHA.9.536.4.LC, CHA.9.536.4.H1, CHA.9.536.4.H2, CHA.9.536.4.H3; CHA.9.536.4.H4, CHA.9.536.4.H4(S241P), CHA.9.536.4.vhCDR1, CHA.9.536.4.vhCDR2, CHA.9.536.4.vhCDR3, CHA.9.536.4.vlCDR1, CHA.9.536.4.vlCDR2 and CHA.9.536.4.vhCDR3;

CHA.9.536.5, CHA.9.536.5.VH, CHA.9.536.5.VL, CHA.9.536.5.HC, CHA.9.536.5.LC, CHA.9.536.5.H1, CHA.9.536.5.H2, CHA.9.536.5.H3; CHA.9.536.5.H4, CHA.9.536.5.H4(S241P), CHA.9.536.5.vhCDR1, CHA.9.536.5.vhCDR2, CHA.9.536.5.vhCDR3, CHA.9.536.5.vlCDR1, CHA.9.536.5.vlCDR2 and CHA.9.536.5.vhCDR3;

CHA.9.536.6, CHA.9.536.6.VH, CHA.9.536.6.VL, CHA.9.536.6.HC, CHA.9.536.6.LC, CHA.9.536.6.H1, CHA.9.536.6.H2, CHA.9.536.6.H3; CHA.9.536.6.H4, CHA.9.536.6.vhCDR1, CHA.9.536.6.vhCDR2, CHA.9.536.6.vhCDR3, CHA.9.536.6.vlCDR1, CHA.9.536.6.vlCDR2 and CHA.9.536.6.vhCDR3;

CHA.9.536.7, CHA.9.536.7.VH, CHA.9.536.7.VL, CHA.9.536.7.HC, CHA.9.536.7.LC, CHA.9.536.7.H1, CHA.9.536.7.H2, CHA.9.536.7.H3; CHA.9.536.7.H4, CHA.9.536.5.H4(S241P); CHA.9.536.7.vhCDR1, CHA.9.536.7.vhCDR2, CHA.9.536.7.vhCDR3, CHA.9.536.7.vlCDR1, CHA.9.536.7.vlCDR2 and CHA.9.536.7.vhCDR3;

CHA.9.536.8, CHA.9.536.8.VH, CHA.9.536.8.VL, CHA.9.536.8.HC, CHA.9.536.8.LC, CHA.9.536.8.H1, CHA.9.536.8.H2, CHA.9.536.8.H3; CHA.9.536.8.H4, CHA.9.536.8.H4(S241P), CHA.9.536.8.vhCDR1, CHA.9.536.8.vhCDR2, CHA.9.536.8.vhCDR3, CHA.9.536.8.vlCDR1, CHA.9.536.8.vlCDR2 and CHA.9.536.8.vhCDR3;

CHA.9.560.1, CHA.9.560.1VH, CHA.9.560.1.VL, CHA.9.560.1.HC, CHA.9.560.1.LC, CHA.9.560.1.H1, CHA.9.560.1.H2, CHA.9.560.1.H3; CHA.9.560.1.H4, CHA.9.560.1.H4(S241P), CHA.9.560.1.vhCDR1, CHA.9.560.1.vhCDR2, CHA.9.560.1.vhCDR3, CHA.9.560.1.vlCDR1, CHA.9.560.1.vlCDR2 and CHA.9.560.1.vhCDR3;

CHA.9.560.3, CHA.9.560.3VH, CHA.9.560.3.VL, CHA.9.560.3.HC, CHA.9.560.3.LC, CHA.9.560.3.H1, CHA.9.560.3.H2, CHA.9.560.3.H3; CHA.9.560.3.H4, CHA.9.560.3.H4(S241P); CHA.9.560.3.vhCDR1, CHA.9.560.3.vhCDR2, CHA.9.560.3.vhCDR3, CHA.9.560.3.vlCDR1, CHA.9.560.3.vlCDR2 and CHA.9.560.3.vhCDR3;

CHA.9.560.4, CHA.9.560.4VH, CHA.9.560.4.VL, CHA.9.560.4.HC, CHA.9.560.4.LC, CHA.9.560.4.H1, CHA.9.560.4.H2, CHA.9.560.4.H3; CHA.9.560.4.H4, CHA.9.560.4.H4(S241P), CHA.9.560.4.vhCDR1, CHA.9.560.4.vhCDR2, CHA.9.560.4.vhCDR3, CHA.9.560.4.vlCDR1, CHA.9.560.4.vlCDR2 and CHA.9.560.4.vhCDR3;

CHA.9.560.5, CHA.9.560.5VH, CHA.9.560.5.VL, CHA.9.560.5.HC, CHA.9.560.5.LC, CHA.9.560.5.H1, CHA.9.560.5.H2, CHA.9.560.5.H3; CHA.9.560.5.H4, CHA.9.560.5.vhCDR1, CHA.9.560.5.vhCDR2, CHA.9.560.5.vhCDR3, CHA.9.560.5.vlCDR1, CHA.9.560.5.vlCDR2 and CHA.9.560.5.vhCDR3;

CHA.9.560.6, CHA.9.560.6VH, CHA.9.560.6.VL, CHA.9.560.6.HC, CHA.9.560.6.LC, CHA.9.560.6.H1, CHA.9.560.6.H2, CHA.9.560.6.H3; CHA.9.560.6.H4, CHA.9.560.6.H4(S241P), CHA.9.560.6.vhCDR1, CHA.9.560.6.vhCDR2, CHA.9.560.6.vhCDR3, CHA.9.560.6.vlCDR1, CHA.9.560.6.vlCDR2 and CHA.9.560.6.vhCDR3;

CHA.9.560.7, CHA.9.560.7VH, CHA.9.560.7.VL, CHA.9.560.7.HC, CHA.9.560.7.LC, CHA.9.560.7.H1, CHA.9.560.7.H2, CHA.9.560.7.H3; CHA.9.560.7.H4; CHA.9.560.7.H4(S241P); CHA.9.560.7.vhCDR1, CHA.9.560.7.vhCDR2, CHA.9.560.7.vhCDR3, CHA.9.560.7.vlCDR1, CHA.9.560.7.vlCDR2 and CHA.9.560.7.vhCDR3;

CHA.9.560.8, CHA.9.560.8VH, CHA.9.560.8.VL, CHA.9.560.8.HC, CHA.9.560.8.LC, CHA.9.560.8.H1, CHA.9.560.8.H2, CHA.9.560.8.H3; CHA.9.560.8.H4, CHA.9.560.8.H4(S241P); CHA.9.560.8.vhCDR1, CHA.9.560.8.vhCDR2, CHA.9.560.8.vhCDR3, CHA.9.560.8.vlCDR1, CHA.9.560.8.vlCDR2 and CHA.9.560.8.vhCDR3;

CHA.9.546.1, CHA.9.546.1VH, CHA.9.546.1.VL, CHA.9.546.1.HC, CHA.9.546.1.LC, CHA.9.546.1.H1, CHA.9.546.1.H2, CHA.9.546.1.H3; CHA.9.546.1.H4, CHA.9.546.1.H4(S241P), CHA.9.546.1.vhCDR1, CHA.9.546.1.vhCDR2, CHA.9.546.1.vhCDR3, CHA.9.546.1.vlCDR1, CHA.9.546.1.vlCDR2 and CHA.9.546.1.vhCDR3;

CHA.9.547.1, CHA.9.547.1VH, CHA.9.547.1.VL, CHA.9.547.1.HC, CHA.9.547.1.LC, CHA.9.547.1.H1, CHA.9.547.1.H2, CHA.9.547.1.H3; CHA.9.547.1.H4, CHA.9.547.1.H4(S241P), CHA.9.547.1.vhCDR1, CHA.9.547.1.vhCDR2, CHA.9.547.1.vhCDR3, CHA.9.547.1.vlCDR1, CHA.9.547.1.vlCDR2 and CHA.9.547.1.vhCDR3;

CHA.9.547.2, CHA.9.547.2VH, CHA.9.547.2.VL, CHA.9.547.2.HC, CHA.9.547.2.LC, CHA.9.547.2.H1, CHA.9.547.2.H2, CHA.9.547.2.H3; CHA.9.547.2.H4, CHA.9.547.2.H4(S241P), CHA.9.547.2.vhCDR1, CHA.9.547.2.vhCDR2, CHA.9.547.2.vhCDR3, CHA.9.547.2.vlCDR1, CHA.9.547.2.vlCDR2 and CHA.9.547.2.vhCDR3;

CHA.9.547.3, CHA.9.547.3VH, CHA.9.547.3.VL, CHA.9.547.3.HC, CHA.9.547.3.LC, CHA.9.547.3.H1, CHA.9.547.3.H2, CHA.9.547.3.H3; CHA.9.547.3.H4, CHA.9.547.3.H4(S241P), CHA.9.547.3.vhCDR1, CHA.9.547.3.vhCDR2, CHA.9.547.3.vhCDR3, CHA.9.547.3.vlCDR1, CHA.9.547.3.vlCDR2 and CHA.9.547.3.vhCDR3;

CHA.9.547.4, CHA.9.547.4VH, CHA.9.547.4.VL, CHA.9.547.4.HC, CHA.9.547.4.LC, CHA.9.547.4.H1, CHA.9.547.4.H2, CHA.9.547.4.H3; CHA.9.547.4.H4, CHA.9.547.4.H4(S241P), CHA.9.547.4.vhCDR1, CHA.9.547.4.vhCDR2, CHA.9.547.4.vhCDR3, CHA.9.547.4.vlCDR1, CHA.9.547.4.vlCDR2 and CHA.9.547.4.vhCDR3;

CHA.9.547.6, CHA.9.547.6 VH, CHA.9.547.6.VL, CHA.9.547.6.HC, CHA.9.547.6.LC, CHA.9.547.6.H1, CHA.9.547.6.H2, CHA.9.547.6.H3; CHA.9.547.6.H4, CHA.9.547.6.H4(S241P), CHA.9.547.6.vhCDR1, CHA.9.547.6.vhCDR2, CHA.9.547.6.vhCDR3, CHA.9.547.6.vlCDR1, CHA.9.547.6.vlCDR2 and CHA.9.547.6.vhCDR3;

CHA.9.547.7, CHA.9.547.7VH, CHA.9.547.7.VL, CHA.9.547.7.HC, CHA.9.547.7.LC, CHA.9.547.7.H1, CHA.9.547.7.H2, CHA.9.547.7.H3; CHA.9.547.7.H4, CHA.9.547.7.H4(S241P), CHA.9.547.7.vhCDR1, CHA.9.547.7.vhCDR2, CHA.9.547.7.vhCDR3, CHA.9.547.7.vlCDR1, CHA.9.547.7.vlCDR2 and CHA.9.547.7.vhCDR3;

CHA.9.547.8, CHA.9.547.8VH, CHA.9.547.8.VL, CHA.9.547.8.HC, CHA.9.547.8.LC, CHA.9.547.8.H1, CHA.9.547.8.H2, CHA.9.547.8.H3; CHA.9.547.8.H4, CHA.9.547.8.H4(S241P), CHA.9.547.8.vhCDR1, CHA.9.547. 8.vhCDR2, CHA.9.547.8.vhCDR3, CHA.9.547.8.vlCDR1, CHA.9.547.8.vlCDR2 and CHA.9.547.8.vhCDR3;

CHA.9.547.9, CHA.9.547.9, CHA.9.547.9VH, CHA.9.547.9.VL, CHA.9. 547.9.HC, CHA.9.547.9.LC, CHA.9.547.9.H1, CHA.9.547.9.H2, CHA.9.547.9.H3; CHA.9.547.9.H4, CHA.9.547.9.H4, CHA.9.547.9.H4 (S241P), CHA.9.547.9.H4(S241P), CHA.9.547.9.vhCDR1, CHA.9.547.9.vhCDR2, CHA.9.547.9.vhCDR3, CHA.9.547.9.vlCDR1, CHA.9.547.9.vlCDR2 and CHA.9.547.9.vhCDR3;

CHA.9.547.13, CHA.9.547.13, CHA.9.547.13VH, CHA.9.547.13.VL, CHA.9.547.13.HC, CHA.9.547.13.LC, CHA.9.547.13.H1, CHA.9.547.13.H2, CHA.9. 547.13.H3; CHA.9.547.13.H4, CHA.9.547.13.H4, CHA.9.547.13.H4 (S241P), CHA.9.547.13.H4(S241P), CHA.9.547.13.vhCDR1, CHA.9.547.13.vhCDR2, CHA.9.547. 13.vhCDR3, CHA.9.547.13.vlCDR1, CHA.9.547.13.vlCDR2 and CHA.9.547. 13.vhCDR3;

CHA.9.541.1, CHA.9.541.1.VH, CHA.9.541.1.VL, CHA.9.541.1.HC, CHA.9.541.1.LC, CHA.9.541.1.H1, CHA.9.541.1.H2, CHA.9.541.1.H3; CHA.9.541.1.H4, CHA.9.541.1.H4(S241P), CHA.9.541.1.vhCDR1, CHA.9. 541.1.vhCDR2, CHA.9.541.1.vhCDR3, CHA.9.541.1.vlCDR1, CHA.9.541.1.vlCDR2 and CHA.9.541.1.vhCDR3;

CHA.9.541.3, CHA.9.541.3.VH, CHA.9.541.3.VL, CHA.9.541.3.HC, CHA.9.541.3.LC, CHA.9.541.3.H1, CHA.9.541.3.H2, CHA.9.541.3.H3; CHA.9.541.3.H4, CHA.9.541.3.H4(S241P), CHA.9.541.3.vhCDR1, CHA.9.541. 3.vhCDR2, CHA.9.541.3.vhCDR3, CHA.9.541.3.vlCDR1, CHA.9.541.3.vlCDR2 and CHA.9.541.3.vhCDR3;

CHA.9.541.4, CHA.9.541.4.VH, CHA.9.541.4.VL, CHA.9.541.4.HC, CHA.9.541.4.LC, CHA.9.541.4.H1, CHA.9.541.4.H2, CHA.9.541.4.H3; CHA.9.541.4.H4, CHA.9.541.4.H4(S241P), CHA.9.541.4.vhCDR1, CHA.9.541. 4.vhCDR2, CHA.9.541.4.vhCDR3, CHA.9.541.4.vlCDR1, CHA.9.541.4.vlCDR2 and CHA.9.541.4.vhCDR3;

CHA.9.541.5, CHA.9.541.5.VH, CHA.9.541.5.VL, CHA.9.541.5.HC, CHA.9.541.5.LC, CHA.9.541.5.H1, CHA.9.541.5.H2, CHA.9.541.5.H3; CHA.9.541.5.H4, CHA.9.541.5.H4(S241P), CHA.9.541.5.vhCDR1, CHA.9.541. 5.vhCDR2, CHA.9.541.5.vhCDR3, CHA.9.541.5.vlCDR1, CHA.9.541.5.vlCDR2 and CHA.9.541.5.vhCDR3;

CHA.9.541.6, CHA.9.541.6.VH, CHA.9.541.6.VL, CHA.9.541.6.HC, CHA.9.541.6.LC, CHA.9.541.6.H1, CHA.9.541.6.H2, CHA.9.541.6.H3; CHA.9.541.6.H4, CHA.9.541.6.H4(S241P), CHA.9.541.6.vhCDR1, CHA.9.541. 6.vhCDR2, CHA.9.541.6.vhCDR3, CHA.9.541.6.vlCDR1, CHA.9.541.6.vlCDR2 and CHA.9.541.6.vhCDR3;

CHA.9.541.7, CHA.9.541.7.VH, CHA.9.541.7.VL, CHA.9.541.7.HC, CHA.9.541.7.LC, CHA.9.541.7.H1, CHA.9.541.7.H2, CHA.9.541.7.H3; CHA.9.541.7.H4, CHA.9.541.7.H4(S241P), CHA.9.541.7.vhCDR1, CHA.9.541. 7.vhCDR2, CHA.9.541.7.vhCDR3, CHA.9.541.7.vlCDR1, CHA.9.541.7.vlCDR2 and CHA.9.541.7.vhCDR3; and CHA.9.541.8, CHA.9.541.8.VH, CHA.9.541.8.VL, CHA.9.541.8.HC, CHA.9.541.8.LC, CHA.9.541.8.H1, CHA.9.541.8.H2, CHA.9.541.8.H3; CHA.9.541.8.H4, CHA.9.541.8.H4(S241P); CHA.9.541.8vhCDR1, CHA.9.541. 8.vhCDR2, CHA.9.541.8.vhCDR3, CHA.9.541.8.vlCDR1, CHA.9.541.8.vlCDR2 and CHA.9.541.8.vhCDR3.

In the case of scFvs comprising the CDRs of the antibodies above, these are labeled as scFvs that include a scFv comprising a variable heavy domain with the vhCDRs, a linker and a variable light domain with the vlCDRs, again as above in either orientation. Thus the invention includes the use of scFv-CHA.9.536.3.1, scFv-CHA.9.536.3, scFv-CHA.9.536.4, scFv-CHA.9.536.5, scFv-CHA.9.536.7, scFv-CHA.9.536.8, scFv-CHA.9.560.1, scFv-CHA.9.560.3, scFv-CHA.9.560.4, scFv-CHA.9.560.5, scFv-CHA.9.560.6, scFv-CHA.9.560.7, scFv-CHA.9.560.8, scFv-CHA.9.546.1, scFv-CHA.9.547.1, scFv-CHA.9.547.2, scFv-CHA.9.547.3, scFv-CHA.9.547.4, scFv-CHA.9.547.6, scFv-CHA.9.547.7, scFv-CHA.9.547.8, scFv-CHA.9.547.9, scFv-CHA.9.547.13, scFv-CHA.9.541.1, scFv-CHA.9.541.3, scFv-CHA.9.541.4, scFv-CHA.9.541.5, scFv-CHA.9.541.6, scFv-CHA.9.541.7 and scFv-CHA.9.541.8.

In addition, CHA.9.543 binds to TIGIT but does not block the TIGIT-PVR interaction.

As discussed herein, the invention further provides for the use of variants of the above components (CPA and CHA), including variants in the CDRs, as outlined above. Thus, the invention provides antibodies comprising a set of 6 CDRs as outlined herein that can contain one, two or three amino acid differences in the set of CDRs, as long as the antibody still binds to TIGIT. Suitable assays for testing whether an anti-TIGIT antibody that contains mutations as compared to the CDR sequences outlined herein are known in the art, such as Biacore assays.

In addition, the invention further provides for the use of variants of the above variable heavy and light chains. In this case, the variable heavy chains can be 80%, 90%, 95%, 98% or 99% identical to the "VH" sequences herein, and/or contain from 1, 2, 3, 4, 5, 6, 7, 8, 9, 10 amino acid changes, or more, when Fc variants are used. Variable light chains are provided that can be 80%, 90%, 95%, 98% or 99% identical to the "VL" sequences herein (and in particular CPA.9.086), and/or contain from 1, 2, 3, 4, 5, 6, 7, 8, 9, 10 amino acid changes, or more, when Fc variants are used. In these embodiments, the anti-TIGIT antibodies for use in the present invention still binds to TIGIT. Suitable assays for testing whether an anti-TIGIT antibody that contains mutations as compared to the CDR sequences outlined herein are known in the art, such as Biacore assays.

Similarly, heavy and light chains are provided that are 80%, 90%, 95%, 98% or 99% identical to the full length "HC" and "LC" sequences herein (and in particular CPA.9.086), and/or contain from 1, 2, 3, 4, 5, 6, 7, 8, 9, 10 amino acid changes, or more, when Fc variants are used. In these embodiments, the invention includes these variants as long as the anti-TIGIT antibody still binds to TIGIT. Suitable assays for testing whether an anti-TIGIT antibody that contains mutations as compared to the CDR sequences outlined herein are known in the art, such as Biacore assays.

In addition, the framework regions of the variable heavy and variable light chains of either the CPA or CHA antibodies herein can be humanized (or, in the case of the CHA antibodies, "rehumanized", to the extent that alternative humanization methods can be done) as is known in the art (with occasional variants generated in the CDRs as needed), and thus humanized variants of the VH and VL chains of FIG. 23 can be generated (and in particular CPA.9.086). Furthermore, the humanized variable heavy and light domains can then be fused with human constant regions, such as the constant regions from IgG1, IgG2, IgG3 and IgG4 (including IgG4(S241P)).

In particular, as is known in the art, murine VH and VL chains can be humanized as is known in the art, for example, using the IgBLAST program of the NCBI website, as outlined in Ye et al. Nucleic Acids Res. 41:W34-W40 (2013), herein incorporated by reference in its entirety for the humanization methods. IgBLAST takes a murine VH and/or VL sequence and compares it to a library of known human germline sequences. As shown herein, for the humanized sequences generated herein, the databases used were IMGT human VH genes (F+ORF, 273 germline sequences) and IMGT human VL kappa genes (F+ORF, 74 germline sequences). An exemplary five CHA sequences were chosen: CHA.9.536, CHA9.560, CHA.9.546, CHA.9.547 and CHA.9.541 (see FIG. 3). For this embodiment of the humanization, human germline IGHV1-46(allelel) was chosen for all 5 as the acceptor sequence and the human heavy chain IGHJ4(allelel) joining region (J gene). For three of four (CHA.7.518, CHA.7.530, CHA.7.538_1 and CHA.7.538_2), human germline IGKV1-39(allele 1) was chosen as the acceptor sequence and human light chain IGKJ2(allelel) (J gene) was chosen. The J gene was chosen from human joining region sequences compiled at IMGT® the international ImMunoGeneTics information system as www.imgt.org. CDRs were defined according to the AbM definition (see www.bioinfo.org.uk/abs/). In some embodiments, the anti-TIGIT antibodies for use in the present invention include TIGIT binding portions or antigen binding domains wherein the $V_H$ and $V_L$ sequences of different TIGIT binding portions or antigen binding domains can be "mixed and matched" to create other TIGIT binding portions or antigen binding domains. TIGIT binding of such "mixed and matched" anti-TIGIT antibodies can be tested using the binding assays described above. e.g., ELISAs or Biacore assays). In some embodiments, when $V_H$ and $V_L$ chains are mixed and matched, a $V_H$ sequence from a particular $V_H/V_L$ pairing is replaced with a structurally similar $V_H$ sequence. Likewise, in some embodiments, a $V_L$ sequence from a particular $V_H/V_L$ pairing is replaced with a structurally similar $V_L$ sequence. For example, the $V_H$ and $V_L$ sequences of homologous antibodies are particularly amenable for mixing and matching.

Accordingly, the anti-TIGIT antibodies for use in the present invention can comprise CDR amino acid sequences selected from the group consisting of (a) sequences as listed herein; (b) sequences that differ from those CDR amino acid sequences specified in (a) by 1, 2, 3, 4, 5, 6, 7, 8, 9, 10 or more amino acid substitutions; (c) amino acid sequences having 90% or greater, 95% or greater, 98% or greater, or 99% or greater sequence identity to the sequences specified in (a) or (b); (d) a polypeptide having an amino acid sequence encoded by a polynucleotide having a nucleic acid sequence encoding the amino acids as listed herein. In particular, the anti-TIGIT antibody can comprise the antigen binding domain from the CPA.9.086 antibody which can have sequences selected from (a), (b), (c) or (d).

Additionally included in the definition of the anti-TIGIT antibodies for use in the present invention are antibodies that comprise TIGIT binding domains that share identity to the binding domains from the TIGIT antibodies enumerated herein. That is, in certain embodiments, an anti-TIGIT antibody according to the invention comprises heavy and light chain variable regions comprising amino acid sequences that are identical to all or part of the binding domains from the anti-TIGIT amino acid sequences of preferred anti-TIGIT antibodies, respectively, wherein the antibodies retain the desired functional properties of the parent anti-TIGIT antibodies. The percent identity between the two sequences is a function of the number of identical positions shared by the sequences (i.e., % homology=# of identical positions/total # of positions ×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (*Comput. Appl. Biosci.*, 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* 48:444-453 (1970)) algorithm which has been incorporated into the GAP program in the GCG software package (available commercially), using either a Blossum 62 matrix or a PAM250 matrix, and a gap weight of 16, 14, 12, 10, 8, 6, or 4 and a length weight of 1, 2, 3, 4, 5, or 6.

In general, the percentage identity for comparison between TIGIT binding domains or antigen binding domains is at least 75%, at least 80%, at least 90%, with at least about 95%, 96%, 97%, 98% or 99% percent identity being preferred. The percentage identity may be along the whole amino acid sequence, for example the entire heavy or light chain or along a portion of the chains. For example, included within the definition of the anti-TIGIT antibodies for use in the present invention are those whose TIGIT binding portion or antigen binding domains shares identity along the entire variable region (for example, where the identity is 95% or 98% identical along the variable regions), or along the entire constant region, or along just the Fc domain. In particular, the anti-TIGIT antibodies for use in the present invention include antibodies that have TIGIT binding portions or antigen binding domains with at least 75%, at least 80%, at least 90%, with at least about 95%, 96%, 97%, 98%, or 99% percent identity being preferred, with the CPA.9.086 antibody.

In addition, also included are sequences that may have the identical CDRs but changes in the framework portions of the variable domain (or entire heavy or light chain). For example, anti-TIGIT antibodies for use in the present invention include those with CDRs identical to those shown in FIG. 3 but whose identity along the variable region can be lower, for example 95 or 98 percent identical. In particular, the invention provides for the use of anti-TIGIT antibodies that have TIGIT binding portions or antigen binding domains with identical CDRs to CPA.9.086 but with framework regions that are 95% or 98% identical to CPA.9.086.

D. Anti-TIGIT Antibodies in Combination with Anti-PD-1 Antibodies

In another embodiment, the invention provides combinations of the anti-TIGIT antibodies of the invention and anti-PD-1 antibodies. There are two approved anti-PD-1 antibodies, pembrolizumab (Keytruda®) and nivolumab (Opdivo®) and many more in development which can be used in combination with the anti-TIGIT antibodies of the invention.

Accordingly, the invention provides the specific combinations of: CPA.9.083.H4(S241P) as shown in FIG. 3F with pembrolizumab; CPA.9.083.H4(S241P) as shown in FIG. 3F with nivolumab; CPA.9.086.H4(S241P) as shown in FIG. 3G with pembrolizumab; CPA.9.086.H4(S241P) as shown in FIG. 3G with nivolumab; CHA.9.547.7H4(S241P) as shown in FIG. 4HH with pembrolizumab; CHA.9.547.7H4 (S241P) as shown in FIG. 3HH with nivolumab; CHA.9.547.13.H4(S241P) as shown in FIG. 3VV with pembrolizumab and CHA.9.547.13.H4(S241P) as shown in FIG. 3VV with nivolumab; all from FIG. 4 of U.S. Ser. No. 62/513,916, entitled "Anti-TIGIT Antibodies and Methods of Use", filed on Jun. 1, 2017, by assignee Compugen. Other anti-TIGIT antibodies that can be combined with anti-PD-1 antibodies are provided in FIG. 3 as well.

E. Specific Anti-PVRIG Antibodies

The invention provides antigen binding domains, including full length antibodies, which contain a number of specific, enumerated sets of 6 CDRs and defined variable heavy (vh, VH or $V_H$) and variable light (vl, VL or $V_L$), that bind to PVRIG.

In one embodiment, the anti-PVRIG antibody is an antibody comprising a set of six CDRs (vhCDR1, vhCDR2, vhCDR3, vlCDR1, vlCDR2 and vlCDR3) from CHA.7.518.1.H4(S241P) as depicted in FIG. 5. In one embodiment, the anti-TIGIT antibody is an antibody comprising the variable heavy (vh) and variable light (vl) domains from CHA.7.518.1.H4(S241P) as depicted in FIG. 5, linked to a human IgG constant domain of IgG1, IgG2, IgG3, IgG4 and IgG4(S241P). In one embodiment, the anti-TIGIT antibody is CHA.7.518.1.H4(S241P). In some embodiments, the anti-PVRIG antibody is an anti-PVRIG antibody as shown in FIG. 5 or FIG. 63.

In particular, the 2H6 anti-PVRIG antibody of Zhu et al., WO2017/041004, specifically incorporated herein by reference, can be used, which has a vhCDR1 of SEQ ID NO:6, a vhCDR2 of SEQ ID NO:7, a vhCDR3 of SEQ ID NO:8, a vlCDR1 of SEQ ID NO:9, a vlCDR2 of SEQ ID NO:10 and a vhCDR3 of SEQ ID NO:11 from WO2017/041004. The 2H6 anti-PVRIG antibody of Zhu et al. has a variable heavy domain comprising SEQ ID NO:6 and a variable light domain comprising SEQ ID NO:3, which can be linked to a human IgG constant domain of IgG1, IgG2, IgG3, IgG4 and IgG4(S241P). All SEQ IDs in this paragraph are from WO2017/041004 and are also provided in FIG. 5.

In particular, the 334M5 anti-PVRIG antibody from WO2018/017864, specifically incorporated herein by reference, can be used, which has a vhCDR1 of SEQ ID NO:31, a vhCDR2 of SEQ ID NO:32, a vhCDR3 of SEQ ID NO:33, a vlCDR1 of SEQ ID NO:26, a vlCDR2 of SEQ ID NO:27, and a vhCDR3 of SEQ ID NO:28 from WO2018/017864. The 334M5 anti-PVRIG antibody from WO2018/017864 has a variable heavy domain comprising SEQ ID NO:30 and a variable light domain comprising SEQ ID NO:25, which can be linked to a human IgG constant domain of IgG1, IgG2, IgG3, IgG4 and IgG4(S241P). All SEQ IDs in this paragraph are from WO2018/017864 and are also provided in FIG. 5.

F. Additional Anti-PVRIG Antibodies

The PVRIG antibodies which can find use in according to the triple combinations of the present invention are labeled as follows. These PVRIG antibodies described herein are labeled as follows. The PVRIG antibodies have reference numbers, for example "CPA.7.013". This represents the combination of the variable heavy and variable light chains, as depicted in FIG. 63, for example. "CPA.7.013.VH" refers to the variable heavy portion of CPA.7.013, while "CPA.7.013.VL" is the variable light chain. "CPA.7.013.vhCDR1", "CPA. 7.013.vhCDR2", "CPA. 7.013.vhCDR3", "CPA.7.013.vlCDR1", "CPA.7.013.vlCDR2", and "CPA.7.013.vlCDR3", refers to the CDRs are indicated. "CPA.7.013.HC" refers to the entire heavy chain (e.g. variable and constant domain) of this molecule, and "CPA.7.013.LC" refers to the entire light chain (e.g. variable and constant domain) of the same molecule. "CPA.7.013.H1" refers to a full length antibody comprising the variable heavy and light domains, including the constant domain of Human IgG1 (hence, the H1; IgG1, IgG2, IgG3 and IgG4, as provided in FIG. 1, for example). Accordingly, "CPA.7.013.H2" would be the CPA.7.013 variable domains linked to a Human IgG2. "CPA.7.013.H3" would be the CPA.7.013 variable domains linked to a Human IgG3, and "CPA.7.013.H4" would be the CPA.7.013 variable domains linked to a Human IgG4.

The PVRIG antibodies which can find use in according to the triple combinations of the present invention are labeled as follows. The antibodies have reference numbers, for example "CHA.7.518.1". This represents the combination of the variable heavy and variable light chains, as depicted in FIGS. 5 and 63, for example, with the understanding that these antibodies include two heavy chains and two light chains. "CPA. 7.518.1.VH" refers to the variable heavy portion of CPA. 7.518.1, while "CPA.7.518.1.VL" is the variable light chain. "CPA. 7.518.1.vhCDR1", "CPA.7.518.1.vhCDR2", "CPA. 7.518.1.vhCDR3", "CPA. 7.518.1.vlCDR1", "CPA. 7.518.1.vlCDR2", and "CPA. 7.518.1.vlCDR3", refers to the CDRs are indicated. "CPA. 7.518.1.HC" refers to the entire heavy chain (e.g. variable and constant domain) of this molecule, and "CPA. 7.518.1.LC" refers to the entire light chain (e.g. variable and constant domain) of the same molecule. In general, the human kappa light chain is used for the constant domain of each phage (or humanized hybridoma) antibody herein, although in some embodiments the lambda light constant domain is used. "CPA. 7.518.1.H1" refers to a full-length antibody comprising the variable heavy and light domains, including the constant domain of Human IgG1 (hence, the H1; IgG1, IgG2, IgG3 and IgG4, as provided in FIG. 1, for example). Accordingly, "CPA. 7.518.1.H2" would be the CPA. 7.518.1 variable domains linked to a Human IgG2. "CPA. 7.518.1.H3" would be the CPA. 7.518.1 variable domains linked to a Human IgG3, and "CPA. 7.518.1.H4" would be the CPA. 7.518.1 variable domains linked to a Human IgG4. Note that in some cases, the human IgGs may have additional mutations, such as described below, and this can be annotated. For example, in many embodiments, there may be a S241P mutation in the human IgG4, and this can be annotated as "CPA. 7.518.1.H4(S241P)" for example. The human IgG4 sequence with this S241P hinge variant is shown in FIG. 1. Other potential variants are IgG1(N297A), (or other variants that ablate glycosylation at this site and thus many of the effector functions associated with FcγRIIIa binding), and IgG1(D265A), which reduces binding to FcγR receptors. The anti-PVRIG antibodies for use in the present invention can comprise any of the PVRIG antibody sequences. The anti-PVRIG antibodies for use in the present invention can comprise any of the PVRIG antigen binding domain sequences.

The invention further provides variable heavy and light domains as well as full length heavy and light chains, any of which can be employed as part of the anti-PVRIG antibodies for use according to the present invention.

In some embodiments, the invention provides scFvs that bind to PVRIG comprising a variable heavy domain and a variable light domain linked by an scFv linker as outlined above. The VL and VH domains can be in either orientation, e.g. from N- to C-terminus "VH-linker-VL" or "VL-linker VH". These are named by their component parts; for example, "scFv-CHA.7.518.1VH-linker-VL" or "scFv-CPA. 7.518.1.VL-linker-VH." Thus, "scFv-CPA. 7.518.1" can be in either orientation. The anti-PVRIG antibodies for use in the present invention can comprise an scFv that binds to PVRIG.

The invention provides antigen binding domains, including full length antibodies, which contain a number of specific, enumerated sets of 6 CDRs. The anti-PVRIG antibodies for use in the present invention can comprise any of the sets of 6 CDRs from the PVRIG antibody sequences provided herein.

The invention further provides variable heavy and light domains as well as full length heavy and light chains.

In many embodiments, the anti-PVRIG antibodies for use in the present invention are human (derived from phage) and block binding of PVRIG and PVLR2. The anti-PVRIG antibodies of the invention can comprise a PVRIG antibody and/or antigen binding domain sequence capable of both binding and blocking the receptor-ligand interaction. The anti-PVRIG can comprise the CDRs from a PVRIG antibody sequence capable of both binding and blocking the receptor-ligand interaction. The CPA antibodies, as well as the CDR sequences, that both bind and block the receptor-ligand interaction are as below, with their components outlined as well, the sequences for which are shown in FIG. 63:

CPA.7.001, CPA.7.001.VH, CPA.7.001.VL, CPA.7.001.HC, CPA.7.001.LC and CPA.7.001.H1, CPA.7.001.H2, CPA.7.001.H3, CPA.7.001.H4; CPA.7.001.vhCDR1, CPA.7.001.vhCDR2, CPA.7.001.vhCDR3, CPA.7.001.vlCDR1, CPA.7.001.vlCDR2, and CPA.7.001.vlCDR3;

CPA.7.003, CPA.7.003.VH, CPA.7.003.VL, CPA.7.003.HC, CPA.7.003.LC, CPA.7.003.H1, CPA.7.003.H2, CPA.7.003.H3, CPA.7.003.H4; CPA.7.003.vhCDR1, CPA.7.003.vhCDR2, CPA.7.003.vhCDR3, CPA.7.003.vlCDR1, CPA.7.003.vlCDR2, and CPA.7.003.vlCDR3;

CPA.7.004, CPA.7.004.VH, CPA.7.004.VL, CPA.7.004.HC, CPA.7.004.LC, CPA.7.004.H1, CPA.7.004.H2, CPA.7.004.H3 CPA.7.004.H4; CPA.7.004.vhCDR1, CPA.7.004.vhCDR2, CPA.7.004.vhCDR3, CPA.7.004.vlCDR1, CPA.7.004.vlCDR2, and CPA.7.004.vlCDR3;

CPA.7.006, CPA.7.006.VH, CPA.7.006.VL, CPA.7.006.HC, CPA.7.006.LC, CPA.7.006.H1, CPA.7.006.H2, CPA.7.006.H3 CPA.7.006.H4; CPA.7.006.vhCDR1, CPA.7.006.vhCDR2, CPA.7.006.vhCDR3, CPA.7.006.vlCDR1, CPA.7.006.vlCDR2, and CPA.7.006.vlCDR3;

CPA.7.008, CPA.7.008.VH, CPA.7.008.VL, CPA.7.008.HC, CPA.7.008.LC, CPA.7.008.H1, CPA.7.008.H2, CPA.7.008.H3 CPA.7.008.H4; CPA.7.008.vhCDR1, CPA.7.008.vhCDR2, CPA.7.008.vhCDR3, CPA.7.008.vlCDR1, CPA.7.008.vlCDR2, and CPA.7.008.vlCDR3;

CPA.7.009, CPA.7.009.VH, CPA.7.009.VL, CPA.7.009.HC, CPA.7.009.LC, CPA.7.009.H1, CPA.7.009.H2, CPA.7.009.H3 CPA.7.009.H4; CPA.7.009.vhCDR1, CPA.7.009.vhCDR2, CPA.7.009.vhCDR3, CPA.7.009.vlCDR1, CPA.7.009.vlCDR2, and CPA.7.009.vlCDR3;

CPA.7.010, CPA.7.010.VH, CPA.7.010.VL, CPA.7.010.HC, CPA.7.010.LC, CPA.7.010.H1, CPA.7.010.H2, CPA.7.010.H3 CPA.7.010.H4; CPA.7.010.vhCDR1, CPA.7.010.vhCDR2, CPA.7.010.vhCDR3, CPA.7.010.vlCDR1, CPA.7.010.vlCDR2, and CPA.7.010.vlCDR3;

CPA.7.011, CPA.7.011.VH, CPA.7.011.VL, CPA.7.011.HC, CPA.7.011.LC, CPA.7.011.H1, CPA.7.011.H2, CPA.7.011.H3 CPA.7.011.H4; CPA.7.011.vhCDR1, CPA.7.011.vhCDR2, CPA.7.011.vhCDR3, CPA.7.011.vlCDR1, CPA.7.011.vlCDR2, and CPA.7.011.vlCDR3;

CPA.7.012, CPA.7.012.VH, CPA.7.012.VL, CPA.7.012.HC, CPA.7.012.LC, CPA.7.012.H1, CPA.7.012.H2, CPA.7.012.H3 CPA.7.012.H4; CPA.7.012.vhCDR1, CPA.7.012.vhCDR2, CPA.7.012.vhCDR3, CPA.7.012.vlCDR1, CPA.7.012.vlCDR2, and CPA.7.012.vlCDR3;

CPA.7.013, CPA.7.013.VH, CPA.7.013.VL, CPA.7.013.HC, CPA.7.013.LC, CPA.7.013.H1, CPA.7.013.H2, CPA.7.013.H3 CPA.7.013.H4; CPA.7.013.vhCDR1, CPA.7.013.vhCDR2, CPA.7.013.vhCDR3, CPA.7.013.vlCDR1, CPA.7.013.vlCDR2, and CPA.7.013.vlCDR3;

CPA.7.014, CPA.7.014.VH, CPA.7.014.VL, CPA.7.014.HC, CPA.7.014.LC, CPA.7.014.H1, CPA.7.014.H2, CPA.7.014.H3 CPA.7.014.H4; CPA.7.014.vhCDR1, CPA.7.014.vhCDR2, CPA.7.014.vhCDR3, CPA.7.014.vlCDR1, CPA.7.014.vlCDR2, and CPA.7.014.vlCDR3;

CPA.7.015, CPA.7.015.VH, CPA.7.015.VL, CPA.7.015.HC, CPA.7.015.LC, CPA.7.015.H1, CPA.7.015.H2, CPA.7.015.H3 CPA.7.015.H4; CPA.7.015.vhCDR1, CPA.7.015.vhCDR2, CPA.7.015.vhCDR3, CPA.7.015.vlCDR1, CPA.7.015.vlCDR2, and CPA.7.015.vlCDR3;

CPA.7.017, CPA.7.017.VH, CPA.7.017.VL, CPA.7.017.HC, CPA.7.017.LC, CPA.7.017H1, CPA.7.017.H2, CPA.7.017.H3 CPA.7.017.H4; CPA.7.017.vhCDR1, CPA.7.000171.vhCDR2, CPA.7.017.vhCDR3, CPA.7.017.vlCDR1, CPA.7.017.vlCDR2, and CPA.7.017.vlCDR3;

CPA.7.018, CPA.7.018.VH, CPA.7.018.VL, CPA.7.018.HC, CPA.7.018.LC, CPA.7.018.H1, CPA.7.018.H2, CPA.7.018.H3 CPA.7.018.H4; CPA.7.017.vhCDR1, CPA.7.017.vhCDR2, CPA.7.017.vhCDR3, CPA.7.017.vlCDR1, CPA.7.017.vlCDR2, and CPA.7.017.vlCDR3;

CPA.7.019, CPA.7.019.VH, CPA.7.019.VL, CPA.7.019.HC, CPA.7.019.LC, CPA.7.019.H1, CPA.7.019.H2, CPA.7.019.H3 CPA.7.019.H4; CPA.7.019.vhCDR1, CPA.7.019.vhCDR2, CPA.7.019.vhCDR3, CPA.7.019.vlCDR1, CPA.7.019.vlCDR2, and CPA.7.019.vlCDR3;

CPA.7.021, CPA.7.021.VH, CPA.7.021.VL, CPA.7.021.HC, CPA.7.021.LC, CPA.7.021.H1, CPA.7.021.H2, CPA.7.021.H3 CPA.7.021.H4; CPA.7.021.vhCDR1, CPA.7.021.vhCDR2, CPA.7.021.vhCDR3, CPA.7.021.vlCDR1, CPA.7.021.vlCDR2, and CPA.7.021.vlCDR3;

CPA.7.022, CPA.7.022.VH, CPA.7.022.VL, CPA.7.022.HC, CPA.7.022.LC, CPA.7.022.H1, CPA.7.022.H2, CPA.7.022.H3 CPA.7.022.H4; CPA.7.022.vhCDR1, CPA.7.022.vhCDR2, CPA.7.002201.vhCDR3, CPA.7.022.vlCDR1, CPA.7.022.vlCDR2, and CPA.7.022.vlCDR3;

CPA.7.023, CPA.7.023.VH, CPA.7.023.VL, CPA.7.023.HC, CPA.7.023.LC, CPA.7.023.H1, CPA.7.023.H2, CPA.7.023.H3 CPA.7.023.H4; CPA.7.023.vhCDR1, CPA.7.023.vhCDR2,

CPA.7.023.vhCDR3, CPA.7.023.vlCDR1, CPA.7.023.vlCDR2, and CPA.7.023.vlCDR3;
CPA.7.024, CPA.7.024.VH, CPA.7.024.VL, CPA.7.024.HC, CPA.7.024.LC, CPA.7.024.H1, CPA.7.024.H2, CPA.7.024.H3 CPA.7.024.H4; CPA.7.024.vhCDR1, CPA.7.024.vhCDR2, CPA.7.024.vhCDR3, CPA.7.024.vlCDR1, CPA.7.024.vlCDR2, and CPA.7.024.vlCDR3;
CPA.7.033, CPA.7.033.VH, CPA.7.033.VL, CPA.7.033.HC, CPA.7.033.LC, CPA.7.033.H1, CPA.7.033.H2, CPA.7.033.H3 CPA.7.033.H4; CPA.7.033.vhCDR1, CPA.7.033.vhCDR2, CPA.7.033.vhCDR3, CPA.7.033.vlCDR1, CPA.7.033.vlCDR2, and CPA.7.033.vlCDR3;
CPA.7.034, CPA.7.034.VH, CPA.7.034.VL, CPA.7.034.HC, CPA.7.034.LC, CPA.7.034.H1, CPA.7.034.H2, CPA.7.034.H3 CPA.7.034.H4; CPA.7.034.vhCDR1, CPA.7.034.vhCDR2, CPA.7.034.vhCDR3, CPA.7.034.vlCDR1, CPA.7.034.vlCDR2, and CPA.7.034.vlCDR3;
CPA.7.036, CPA.7.036.VH, CPA.7.036.VL, CPA.7.036.HC, CPA.7.036.LC, CPA.7.036.H1, CPA.7.036.H2, CPA.7.036.H3 CPA.7.036.H4; CPA.7.036.vhCDR1, CPA.7.036.vhCDR2, CPA.7.036.vhCDR3, CPA.7.036.vlCDR1, CPA.7.036.vlCDR2, and CPA.7.036.vlCDR3;
CPA.7.040, CPA.7.040.VH, CPA.7.040.VL, CPA.7.040.HC, CPA.7.040.LC, CPA.7.040.H1, CPA.7.040.H2, CPA.7.040.H3 and CPA.7.040.H4; CPA.7.040.vhCDR1, CPA.7.040.vhCDR2, CPA.7.040.vhCDR3, CPA.7.040.vlCDR1, CPA.7.040.vlCDR2, and CPA.7.040.vlCDR3;
CPA.7.046, CPA.7.046.VH, CPA.7.046.VL, CPA.7.046.HC, CPA.7.046.LC, CPA.7.046.H1, CPA.7.046.H2, CPA.7.046.H3 CPA.7.046.H4; CPA.7.046.vhCDR1, CPA.7.046.vhCDR2, CPA.7.046.vhCDR3, CPA.7.046.vlCDR1, CPA.7.046.vlCDR2, and CPA.7.046.vlCDR3;
CPA.7.047, CPA.7.047.VH, CPA.7.047.VL, CPA.7.047.HC, CPA.7.047.LC, CPA.7.047.H1, CPA.7.047.H2, CPA.7.047.H3 CPA.7.047.H4; CPA.7.047.vhCDR1, CPA.7.047.vhCDR2, CPA.7.047.vhCDR3, CPA.7.047.vlCDR1, CPA.7.004701.vlCDR2, and CPA.7.047.vlCDR3;
CPA.7.049, CPA.7.049.VH, CPA.7.049.VL, CPA.7.049.HC, CPA.7.049.LC, CPA.7.049.H1, CPA.7.049.H2, CPA.7.049.H3 CPA.7.049.H4; CPA.7.049.vhCDR1, CPA.7.049.vhCDR2, CPA.7.049.vhCDR3, CPA.7.049.vlCDR1, CPA.7.049.vlCDR2, and CPA.7.049.vlCDR3; and
CPA.7.050, CPA.7.050.VH, CPA.7.050.VL, CPA.7.050.HC, CPA.7.050.LC, CPA.7.050.H1, CPA.7.050.H2, CPA.7.050.H3 CPA.7.050.H4, CPA.7.050.vhCDR1, CPA.7.050.vhCDR2, CPA.7.050.vhCDR3, CPA.7.050.vlCDR1, CPA.7.050.vlCDR2, and CPA.7.050.vlCDR3.

In addition, there are a number of CPA antibodies generated herein that bound to PVRIG but did not block the interaction of PVRIG and PVLR2. The anti-PVRIG antibodies for use in the present invention can comprise a PVRIG antibody and/or antigen binding domain sequence capable of binding but not blocking the receptor-ligand interaction. The anti-PVRIG for use in the present invention can comprise the CDRs from a PVRIG antibody sequence capable of sequence capable of binding but not blocking the receptor-ligand interaction. The CPA antibodies, as well as the CDR sequences, that bind but do not block the receptor-ligand interaction are as below, with their components outlined as well, the sequences for which are shown in FIG. 63:

CPA.7.028, CPA.7.028.VH, CPA.7.028.VL, CPA.7.028.HC, CPA.7.028.LC, CPA.7.028.H1, CPA.7.028.H2, CPA.7.028.H3 and CPA.7.028.H4; CPA.7.028.vhCDR1, CPA.7.028.vhCDR2, CPA.7.028.vhCDR3, CPA.7.028.vlCDR1, CPA.7.028.vlCDR2, and CPA.7.028.vlCDR3.
CPA.7.030, CPA.7.030.VH, CPA.7.030.VL, CPA.7.030.HC, CPA.7.030.LC, CPA.7.030.H1, CPA.7.030.H2, CPA.7.030.H3 and CPA.7.030.H4; CPA.7.030.vhCDR1, CPA.7.030.vhCDR2, CPA.7.030.vhCDR3, CPA.7.030.vlCDR1, CPA.7.030.vlCDR2, and CPA.7.030.vlCDR3.
CPA.7.041, CPA.7.041.VH, CPA.7.041.VL, CPA.7.041.HC, CPA.7.041.LC, CPA.7.041.H1, CPA.7.041.H2, CPA.7.041.H3 and CPA.7.041.H4; CPA.7.041.vhCDR1, CPA.7.041.vhCDR2, CPA.7.041.vhCDR3, CPA.7.041.vlCDR1, CPA.7.041.vlCDR2, and CPA.7.041.vlCDR3.
CPA.7.016, CPA.7.016.VH, CPA.7.016.VL, CPA.7.016.HC, CPA.7.016.LC, CPA.7.016.H1, CPA.7.016.H2, CPA.7.016.H3 and CPA.7.016.H4; CPA.7.016.vhCDR1, CPA.7.016.vhCDR2, CPA.7.016.vhCDR3, CPA.7.016.vlCDR1, CPA.7.016.vlCDR2, and CPA.7.016.vlCDR3.
CPA.7.020, CPA.7.020.VH, CPA.7.020.VL, CPA.7.020.HC, CPA.7.020.LC, CPA.7.020.H1, CPA.7.020.H2, CPA.7.020.H3 and CPA.7.020.H4; CPA.7.020.vhCDR1, CPA.7.020.vhCDR2, CPA.7.020.vhCDR3, CPA.7.020.vlCDR1, CPA.7.020.vlCDR2, and CPA.7.020.vlCDR3.
CPA.7.038, CPA.7.038.VH, CPA.7.038.VL, CPA.7.038.HC, CPA.7.038.LC, CPA.7.038.H1, CPA.7.038.H2, CPA.7.038.H3 and CPA.7.038.H4; CPA.7.038.vhCDR1, CPA.7.038.vhCDR2, CPA.7.038.vhCDR3, CPA.7.038.vlCDR1, CPA.7.038.vlCDR2, and CPA.7.038.vlCDR3.
CPA.7.044, CPA.7.044.VH, CPA.7.044.VL, CPA.7.044.HC, CPA.7.044.LC, CPA.7.044.H1, CPA.7.044.H2, CPA.7.044.H3 and CPA.7.044.H4; CPA.7.044.vhCDR1, CPA.7.044.vhCDR2, CPA.7.044.vhCDR3, CPA.7.044.vlCDR1, CPA.7.044.vlCDR2, and CPA.7.044.vlCDR3.
CPA.7.045, CPA.7.045.VH, CPA.7.045.VL, CPA.7.045.HC, CPA.7.045.LC, CPA.7.045.H1, CPA.7.045.H2, CPA.7.045.H3 and CPA.7.045.H4; CPA.7.045.vhCDR1, CPA.7.045.vhCDR2, CPA.7.045.vhCDR3, CPA.7.045.vlCDR1, CPA.7.045.vlCDR2, and CPA.7.045.vlCDR3.

As discussed herein, the invention further provides variants of the above components, including variants in the CDRs, as outlined above. In addition, variable heavy chains can be 80%, 90%, 95%, 98% or 99% identical to the "VH" sequences herein, and/or contain from 1, 2, 3, 4, 5, 6, 7, 8, 9, 10 amino acid changes, or more, when Fc variants are used. Variable light chains are provided that can be 80%, 90%, 95%, 98% or 99% identical to the "VL" sequences herein, and/or contain from 1, 2, 3, 4, 5, 6, 7, 8, 9, 10 amino acid changes, or more, when Fc variants are used. Similarly, heavy and light chains are provided that are 80%, 90%, 95%, 98% or 99% identical to the "HC" and "LC" sequences herein, and/or contain from 1, 2, 3, 4, 5, 6, 7, 8, 9, 10 amino acid changes, or more, when Fc variants are used. The anti-PVRIG for use in the present invention can comprise any of these PVRIG antibody and/or antigen binding domain sequences.

Furthermore, the present invention provides a number of CHA antibodies, which are murine antibodies generated from hybridomas. As is well known the art, the six CDRs are useful when put into either human framework variable heavy and variable light regions or when the variable heavy and light domains are humanized. See, for example, FIGS. 5 and 63.

The anti-PVRIG for use in the present the invention can comprise any of the following CHA sets of CDRs from PVRIG antibody sequences. Accordingly, the present invention provides for the use of anti-PVRIG that comprise the following CHA sets of CDRs, the sequences of which are shown in FIG. 5 and/or FIG. 63:

CHA.7.502.vhCDR1, CHA.7.502.vhCDR2, CHA.7.502.vhCDR3, CHA.7.502.vlCDR1, CHA.7.502.vlCDR2, and CHA.7.502.vlCDR3.
CHA.7.503.vhCDR1, CHA.7.503.vhCDR2, CHA.7.503.vhCDR3, CHA.7.503.vlCDR1, CHA.7.503.vlCDR2, and CHA.7.503.vlCDR3.
CHA.7.506.vhCDR1, CHA.7.506.vhCDR2, CHA.7.506.vhCDR3, CHA.7.506.vlCDR1, CHA.7.506.vlCDR2, and CHA.7.506.vlCDR3.
CHA.7.508.vhCDR1, CHA.7.508.vhCDR2, CHA.7.508.vhCDR3, CHA.7.508.vlCDR1, CHA.7.508.vlCDR2, and CHA.7.508.vlCDR3.
CHA.7.510.vhCDR1, CHA.7.510.vhCDR2, CHA.7.510.vhCDR3, CHA.7.510.vlCDR1, CHA.7.510.vlCDR2, and CHA.7.510.vlCDR3.
CHA.7.512.vhCDR1, CHA.7.512.vhCDR2, CHA.7.512.vhCDR3, CHA.7.512.vlCDR1, CHA.7.512.vlCDR2, and CHA.7.512.vlCDR3.
CHA.7.514.vhCDR1, CHA.7.514.vhCDR2, CHA.7.514.vhCDR3, CHA.7.514.vlCDR1, CHA.7.514.vlCDR2, and CHA.7.514.vlCDR3.
CHA.7.516.vhCDR1, CHA.7.516.vhCDR2, CHA.7.516.vhCDR3, CHA.7.516.vlCDR1, CHA.7.516.vlCDR2, and CHA.7.516.vlCDR3.
CHA.7.518.vhCDR1, CHA.7.518.vhCDR2, CHA.7.518.vhCDR3, CHA.7.518.vlCDR1, CHA.7.518.vlCDR2, and CHA.7.518.vlCDR3.
CHA.7.520_1.vhCDR1, CHA.7.520_1.vhCDR2, CHA.7.520_1.vhCDR3, CHA.7.520_1.vlCDR1, CHA.7.520_1.vlCDR2, and CHA.7.520_1.vlCDR3.
CHA.7.520_2.vhCDR1, CHA.7.520_2.vhCDR2, CHA.7.520_2.vhCDR3, CHA.7.520_2.vlCDR1, CHA.7.520_2.vlCDR2, and CHA.7.520_2.vlCDR3.
CHA.7.522.vhCDR1, CHA.7.522.vhCDR2, CHA.7.522.vhCDR3, CHA.7.522.vlCDR1, CHA.7.522.vlCDR2, and CHA.7.522.vlCDR3.
CHA.7.524.vhCDR1, CHA.7.524.vhCDR2, CHA.7.524.vhCDR3, CHA.7.524.vlCDR1, CHA.7.524.vlCDR2, and CHA.7.524.vlCDR3.
CHA.7.526.vhCDR1, CHA.7.526.vhCDR2, CHA.7.526.vhCDR3, CHA.7.526.vlCDR1, CHA.7.526.vlCDR2, and CHA.7.526.vlCDR3.
CHA.7.527.vhCDR1, CHA.7.527.vhCDR2, CHA.7.527.vhCDR3, CHA.7.527.vlCDR1, CHA.7.527.vlCDR2, and CHA.7.527.vlCDR3.
CHA.7.528.vhCDR1, CHA.7.528.vhCDR2, CHA.7.528.vhCDR3, CHA.7.528.vlCDR1, CHA.7.528.vlCDR2, and CHA.7.528.vlCDR3.
CHA.7.530.vhCDR1, CHA.7.530.vhCDR2, CHA.7.530.vhCDR3, CHA.7.530.vlCDR1, CHA.7.530.vlCDR2, and CHA.7.530.vlCDR3.
CHA.7.534.vhCDR1, CHA.7.534.vhCDR2, CHA.7.534.vhCDR3, CHA.7.534.vlCDR1, CHA.7.534.vlCDR2, and CHA.7.534.vlCDR3.
CHA.7.535.vhCDR1, CHA.7.535.vhCDR2, CHA.7.535.vhCDR3, CHA.7.535.vlCDR1, CHA.7.535.vlCDR2, and CHA.7.535.vlCDR3.
CHA.7.537.vhCDR1, CHA.7.537.vhCDR2, CHA.7.537.vhCDR3, CHA.7.537.vlCDR1, CHA.7.537.vlCDR2, and CHA.7.537.vlCDR3.
CHA.7.538_1.vhCDR1, CHA.7.538_1.vhCDR2, CHA.7.538_1.vhCDR3, CHA.7.538_1.vlCDR1, CHA.7.538_1.vlCDR2, and CHA.7.538_1.vlCDR3.
CHA.7.538_2.vhCDR1, CHA.7.538_2.vhCDR2, CHA.7.538_2.vhCDR3, CHA.7.538_2.vlCDR1, CHA.7.538_2.vlCDR2, and CHA.7.538_2.vlCDR3.
CHA.7.543.vhCDR1, CHA.7.543.vhCDR2, CHA.7.543.vhCDR3, CHA.7.543.vlCDR1, CHA.7.543.vlCDR2, and CHA.7.543.vlCDR3.
CHA.7.544.vhCDR1, CHA.7.544.vhCDR2, CHA.7.544.vhCDR3, CHA.7.544.vlCDR1, CHA.7.544.vlCDR2, and CHA.7.544.vlCDR3.
CHA.7.545.vhCDR1, CHA.7.545.vhCDR2, CHA.7.545.vhCDR3, CHA.7.545.vlCDR1, CHA.7.545.vlCDR2, and CHA.7.545.vlCDR3.
CHA.7.546.vhCDR1, CHA.7.546.vhCDR2, CHA.7.546.vhCDR3, CHA.7.546.vlCDR1, CHA.7.546.vlCDR2, and CHA.7.546.vlCDR3.
CHA.7.547.vhCDR1, CHA.7.547.vhCDR2, CHA.7.547.vhCDR3, CHA.7.547.vlCDR1, CHA.7.547.vlCDR2, and CHA.7.547.vlCDR3.
CHA.7.548.vhCDR1, CHA.7.548.vhCDR2, CHA.7.548.vhCDR3, CHA.7.548.vlCDR1, CHA.7.548.vlCDR2, and CHA.7.548.vlCDR3.
CHA.7.549.vhCDR1, CHA.7.549.vhCDR2, CHA.7.549.vhCDR3, CHA.7.549.vlCDR1, CHA.7.549.vlCDR2, and CHA.7.549.vlCDR3.
CHA.7.550.vhCDR1, CHA.7.550.vhCDR2, CHA.7.550.vhCDR3, CHA.7.550.vlCDR1, CHA.7.550.vlCDR2, and CHA.7.550.vlCDR3.

As above, these sets of CDRs may also be amino acid variants as described above.

In addition, the framework regions of the variable heavy and variable light chains can be humanized as is known in the art (with occasional variants generated in the CDRs as needed), and thus humanized variants of the VH and VL chains of FIG. 63 can be generated. Furthermore, the humanized variable heavy and light domains can then be fused with human constant regions, such as the constant regions from IgG1, IgG2, IgG3 and IgG4.

In particular, as is known in the art, murine VH and VL chains can be humanized as is known in the art, for example, using the IgBLAST program of the NCBI website, as outlined in Ye et al. Nucleic Acids Res. 41:W34-W40 (2013), herein incorporated by reference in its entirety for the humanization methods. IgBLAST takes a murine VH and/or VL sequence and compares it to a library of known human germline sequences. As shown herein, for the humanized sequences generated herein, the databases used were IMGT human VH genes (F+ORF, 273 germline sequences) and IMGT human VL kappa genes (F+ORF, 74 germline sequences). An exemplary five CHA sequences were chosen: CHA.7.518, CHA.7.530, CHA.7.538_1, CHA.7.538_2 and CHA.7.524 (see FIGS. 5 and 63 for the VH and VL sequences). For this embodiment of the humanization, human germline IGHV1-46(allele1) was chosen for all 5 as the acceptor sequence and the human heavy chain IGHJ4(allele1) joining region (J gene). For three of four (CHA.7.518, CHA.7.530, CHA.7.538_1 and CHA.7.538_2), human germline IGKV1-39(allele 1) was chosen as the acceptor sequence and human light chain IGKJ2(allelel) (J gene) was chosen. The J gene was chosen from human joining region sequences compiled at IMGT® the international ImMunoGeneTics information system as www.imgt.org. CDRs were defined according to the AbM definition (see www.bioinfo.org.uk/abs/). FIG. 63 also depicts humanized sequences as well as some potential changes to optimize binding to PVRIG. The anti-PVRIG antibodies for use in the present invention can comprise any of these humanized PVRIG antibody or antigen binding domain sequences.

Specific humanized antibodies of CHA antibodies include those shown in FIGS. 5 and 63, for example. The anti-PVRIG for use in the present invention can comprise CHA PVRIG antibody sequences as shown in FIG. 5 or 63. As will be appreciated by those in the art, each humanized variable heavy (Humanized Heavy; HH) and variable light (Humanized Light, HL) sequence can be combined with the constant regions of human IgG1, IgG2, IgG3 and IgG4. That is, CHA.7.518.HH1 is the first humanized variable heavy chain, and CHA.7.518.HH1.1 is the full length heavy chain, comprising the "HH1" humanized sequence with a IgG1 constant region (CHA.7.518.HH1.2 is CHA.7.518.HH1 with IgG2, etc.).

In some embodiments, the anti-PVRIG antibodies for use in the present invention include anti-PVRIG antibodies wherein the $V_H$ and $V_L$ sequences of different anti-PVRIG antibodies can be "mixed and matched" to create other anti-PVRIG antibodies. PVRIG binding of such "mixed and matched" antibodies can be tested using the binding assays described above. e.g., ELISAs). In some embodiments, when $V_H$ and $V_L$ chains are mixed and matched, a $V_H$ sequence from a particular $V_H/V_L$ pairing is replaced with a structurally similar $V_H$ sequence. Likewise, in some embodiments, a $V_L$ sequence from a particular $V_H/V_L$ pairing is replaced with a structurally similar $V_L$ sequence. For example, the $V_H$ and $V_L$ sequences of homologous antibodies are particularly amenable for mixing and matching. The anti-PVRIG for use in the present invention can comprise PVRIG $V_H$ and $V_L$ sequences from different anti-PVRIG antibodies that have been "mixed and matched".

Accordingly, the antibodies of the invention comprise CDR amino acid sequences selected from the group consisting of (a) sequences as listed herein; (b) sequences that differ from those CDR amino acid sequences specified in (a) by 1, 2, 3, 4, 5, 6, 7, 8, 9, 10 or more amino acid substitutions; (c) amino acid sequences having 90% or greater, 95% or greater, 98% or greater, or 99% or greater sequence identity to the sequences specified in (a) or (b); (d) a polypeptide having an amino acid sequence encoded by a polynucleotide having a nucleic acid sequence encoding the amino acids as listed herein. The anti-PVRIG for use in the present invention can comprise PVRIG variant CDR sequences.

Additionally included in the definition of PVRIG antibodies are antibodies that share identity to the anti-PVRIG antibodies enumerated herein. That is, in certain embodiments, an anti-PVRIG antibody according to the invention comprises heavy and light chain variable regions comprising amino acid sequences that are homologous to isolated anti-PVRIG amino acid sequences of preferred anti-PVRIG immune molecules, respectively, wherein the antibodies retain the desired functional properties of the parent anti-PVRIG antibodies. The percent identity between the two sequences is a function of the number of identical positions shared by the sequences (e.g., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below. The anti-PVRIG antibodies for use in the present the invention can comprise heavy and light chain variable regions comprising amino acid sequences that are homologous to isolated anti-PVRIG amino acid sequences as described herein.

The percent identity between two amino acid sequences can be determined using the algorithm of E. Meyers and W. Miller (*Comput. Appl. Biosci.,* 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* 48:444-453 (1970)) algorithm which has been incorporated into the GAP program in the GCG software package (available commercially), using either a Blossum 62 matrix or a PAM250 matrix, and a gap weight of 16, 14, 12, 10, 8, 6, or 4 and a length weight of 1, 2, 3, 4, 5, or 6.

In general, the percentage identity for comparison between PVRIG antibodies is at least 75%, at least 80%, at least 90%, with at least about 95%, 96%, 97%, 98%, or 99% percent identity being preferred. The percentage identity may be along the whole amino acid sequence, for example the entire heavy or light chain or along a portion of the chains. For example, included within the definition of the anti-PVRIG antibodies of the invention are those that share identity along the entire variable region (for example, where the identity is 95% or 98% identical along the variable regions), or along the entire constant region, or along just the Fc domain.

G. TIGIT Antibodies with Anti-Tumor Antibodies

In some embodiments, the anti-TIGIT antibodies of the invention are co-administered with antibodies that, unlike immuno-oncology/checkpoint inhibitors that generally act on the immune system to increase a patient's native immune response, instead are directed against a specific tumor target antigen (TTA). There are a wide number of anti-TTA antibodies either approved or in development that can be combined with the present TIGIT antibodies. Currently approved antibodies, include, but are not limited to, cetuximab, panitumumab, nimotuzumab (all to EGFR), rituximab (CD20), trastuzumab and pertuzumab (HER2), alemtuzumab (CD52), bevacizumab (VEGF), ofatumumab (CD20), denosumab (RANK ligand), brentuximab (CD30), daratumumab (CD38), ibritumomab (CD20) and ipilimumab (CTLA-4). Specific target oncology antibodies in clinical trials that can be combined with the anti-TIGIT antibodies herein include, but are not limited to, anti-CTLA4 mAbs, such as ipilimumab, tremelimumab (see, for Example U.S. Patent Publication No. 2017/0306025); anti-PD-1 such as nivolumab BMS-936558/MDX-1106/ONO-4538, AMP224, CT-011, MK-3475, anti-PD-L1 antagonists such as Atezolizumab (IMpower133), BMS-936559/MDX-1105, MEDI4736, RG-7446/MPDL3280A, as well as those described in U.S. Patent Publication No. 2017/0281764); anti-LAG-3 such as IMP-321, anti-TIM-3, anti-BTLA, anti-B7-H4, anti-B7-H3, Anti-VISTA; agonistic antibodies targeting immunostimulatory proteins, including anti-CD40 mAbs such as CP-870,893, lucatumumab, dacetuzumab; anti-CD137 mAbs such as BMS-663513 urelumab (anti-4-

1BB; see, for example, U.S. Pat. Nos. 7,288,638 and 8,962,804, incorporated by reference herein in their entireties); PF-05082566 utomilumab (see, for example, U.S. Pat. Nos. 8,821,867; 8,337,850; and 9,468,678, as well as International Patent Application Publication No. WO 2012/032433, incorporated by reference herein in their entireties); anti-OX40 mAbs, such as anti-OX40 (see, for example, WO2006/029879 or WO2010096418, incorporated by reference herein in their entireties); anti-GITR mAbs such as TRX518 (see, for example, U.S. Pat. No. 7,812,135, incorporated by reference herein in its entirety); anti-CD27 mAbs, such as varlilumab CDX-1127 (see, for example, WO 2016/145085 and U.S. Patent Publication Nos. US 2011/0274685 and US 2012/0213771, incorporated by reference herein in their entireties) anti-ICOS mAbs (for example, MEDI-570, JTX-2011, and anti-TIM3 antibodies (see, for example, WO 2013/006490 or U.S. Patent Publication No. US 2016/0257758, incorporated by reference herein in their entireties), as well as monoclonal antibodies to prostate cancer, ovarian cancer, breast cancer, endometrial cancer, multiple myeloma, melanoma, lymphomas, lung cancers including small cell lung cancer, kidney cancer, colorectal cancer, pancreatic cancer, gastric cancer, brain cancer, (see generally www.clinicaltrials.gov).

H. Specific Anti-PD-1 Antibodies

In another embodiment, the invention provides combinations of the anti-TIGIT antibodies of the invention and anti-PD-1 antibodies. There are two approved anti-PD-1 antibodies, pembrolizumab (Keytruda®; MK-3475-033), cemiplimab (REGN2810; see US20170174779), and nivolumab (Opdivo®; CheckMate078) and many more in development which can be used in combination with the anti-TIGIT antibodies of the invention. In other embodiments, the anti-PD-1 antibody can include, for example, SHR-1210 (CTR20160175 and CTR20170090), SHR-1210 (CTR20170299 and CTR20170322), JS-001 (CTR20160274), IBI308 (CTR20160735), BGB-A317 (CTR20160872) and/or a PD-1 antibody as recited in U.S. Patent Publication No. 2017/0081409. Exemplary anti-PD-1 antibody sequences are shown in FIG. 7 and any of these can be used with the combination therapy methods described herein.

In some embodiments, the anti-TIGIT antibodies of the invention are combined with anti-PVRIG antibodies as described herein as well as anti-PD-1 antibodies, as described herein or other anti-PD-1 antibodies known in the art, as a triple combination therapy.

I. Specific Anti-PD-L1 Antibodies

In another embodiment, the invention provides combinations of the anti-TIGIT antibodies of the invention and anti-PD-L1 antibodies. There are three approved anti-PD-L1 antibodies, atezolizumab (TECENTRIQ®; MPDL3280A), avelumab (BAVENCIO®; MSB001071 8C), and Durvalumab (MEDI4736), as well as other anti-PD-L1 antibodies in development. Numerous anti-PD-L1 antibodies are available and many more in development which can be used in combination with the anti-TIGIT antibodies of the invention. In embodiments, the PD-L1 antibody is one described in U.S. Patent Publication No. 2017/0281764 as well as International Patent Publication No. WO 2013/079174 (avelumab) and WO 2010/077634 (or U.S. Patent Application No. 20160222117 or U.S. Pat. No. 8,217,149; atezolizumab). In some embodiments, the PD-L1 antibody comprises a heavy chain sequence of SEQ ID NO: 34 and a light chain sequence of SEQ ID NO: 36 (from US 2017/281764). In some embodiments, the PD-L1 antibody is atezolizumab (TECENTRIQ®; MPDL3280A; IMpower110). In some embodiments, the PD-L1 antibody is avelumab (BAVENCIO®; MSB001071 8C). In some embodiments, the PD-L1 antibody is durvalumab (MEDI4736). In some embodiments, the PD-L1 antibody includes, for example, Atezolizumab (IMpower133), BMS-936559/MDX-1105, and/or RG-7446/MPDL3280A, and/or YW243.55.570, as well as any of those provided herein in FIG. 62.

In some embodiments, the anti-TIGIT antibodies of the invention are combined with anti-PVRIG antibodies as described herein as well as anti-PD-L1 antibodies, as described herein or other anti-PD-L1 antibodies known in the art, as a triple combination therapy.

J. Optional Antibody Engineering

The antibodies of the invention can be modified, or engineered, to alter the amino acid sequences by amino acid substitutions. As discussed herein, amino acid substitutions can be made to alter the affinity of the CDRs for the antigen (including both increasing and decreasing binding), as well as to alter additional functional properties of the antibodies. For example, the antibodies may be engineered to include modifications within the Fc region, typically to alter one or more functional properties of the antibody, such as serum half-life, complement fixation, Fc receptor binding, and/or antigen-dependent cellular cytotoxicity. Furthermore, an antibody according to at least some embodiments of the invention may be chemically modified (e.g., one or more chemical moieties can be attached to the antibody) or be modified to alter its glycosylation, again to alter one or more functional properties of the antibody. Such embodiments are described further below. The numbering of residues in the Fc region is that of the EU index of Kabat.

In one embodiment, the hinge region of CH1 is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the antibody.

In still another embodiment, the antibody can be modified to abrogate in vivo Fab arm exchange, in particular when IgG4 constant domains are used. Specifically, this process involves the exchange of IgG4 half-molecules (one heavy chain plus one light chain) between other IgG4 antibodies that effectively results in antibodies which are functionally monovalent. Mutations to the hinge region and constant domains of the heavy chain can abrogate this exchange (see Aalberse, R C, Schuurman J., 2002, *Immunology* 105:9-19). As outlined herein, a mutation that finds particular use in the present invention is the S241P in the context of an IgG4 constant domain. IgG4 finds use in the present invention as it has no significant effector function, and is thus used to block the receptor-ligand binding without cell depletion.

In some embodiments, amino acid substitutions can be made in the Fc region, in general for altering binding to FcγR receptors. By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII-1 (CD16), and FcγRIII-2 (CD16-2), as well as any undiscovered mouse FcγRs or FcγR isoforms or allotypes.

There are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell. Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41) and U.S. Pat. No. 6,737,056, both of which are expressly incorporated herein by reference in their entirety and specifically for the variants disclosed therein.

In yet other embodiments, the Fc region is altered by replacing at least one amino acid residue with a different amino acid residue to alter the effector functions of the antibody. For example, one or more amino acids selected from amino acid residues 234, 235, 236, 237, 297, 318, 320 and 322 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region is modified to increase the ability of the antibody to mediate antibody dependent cellular cytotoxicity (ADCC) and/or to increase the affinity of the antibody for an Fcγ receptor by modifying one or more amino acids at the following positions: 238, 239, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438 or 439. This approach is described further in PCT Publication WO 00/42072 by Presta. Moreover, the binding sites on human IgG1 for FcγRI, FcγRII, FcγRIII and FcRn have been mapped and variants with improved binding have been described (see Shields, R. L. et al. (2001) J. Biol. Chem. 276:6591-6604). Specific mutations at positions 256, 290, 298, 333, 334 and 339 are shown to improve binding to FcγRIII. Additionally, the following combination mutants are shown to improve FcγRIII binding: T256A/S298A, S298A/E333A, S298A/K224A and S298A/E333A/K334A. Furthermore, mutations such as M252Y/S254T/T256E or M428L/N434S improve binding to FcRn and increase antibody circulation half-life (see Chan C A and Carter P J (2010) Nature Rev Immunol 10:301-316).

In addition, the antibodies of the invention are modified to increase its biological half-life. Various approaches are possible. For example, one or more of the following mutations can be introduced: T252L, T254S, T256F, as described in U.S. Pat. No. 6,277,375 to Ward. Alternatively, to increase the biological half-life, the antibody can be altered within the $C_{H1}$ or $C_L$ region to contain a salvage receptor binding epitope taken from two loops of a CH2 domain of an Fc region of an IgG, as described in U.S. Pat. Nos. 5,869,046 and 6,121,022 by Presta et al. Additional mutations to increase serum half-life are disclosed in U.S. Pat. Nos. 8,883,973, 6,737,056 and 7,371,826 and include 428L, 434A, 434S, and 428L/434S.

In still another embodiment, the glycosylation of an antibody is modified. For example, an aglycosylated antibody can be made (i.e., the antibody lacks glycosylation). Glycosylation can be altered to, for example, increase the affinity of the antibody for antigen or reduce effector function such as ADCC. Such carbohydrate modifications can be accomplished by, for example, altering one or more sites of glycosylation within the antibody sequence, for example N297. For example, one or more amino acid substitutions can be made that result in elimination of one or more variable region framework glycosylation sites to thereby eliminate glycosylation at that site, with an alanine replacement finding use in some embodiments.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies according to at least some embodiments of the invention to thereby produce an antibody with altered glycosylation. For example, the cell lines Ms704, Ms705, and Ms709 lack the fucosyltransferase gene, FUT8 (α (1,6) fucosyltransferase), such that antibodies expressed in the Ms704, Ms705, and Ms709 cell lines lack fucose on their carbohydrates. The Ms704, Ms705, and Ms709 FUT8 cell lines are created by the targeted disruption of the FUT8 gene in CHO/DG44 cells using two replacement vectors (see U.S. Patent Publication No. 20040110704 by Yamane et al. and Yamane-Ohnuki et al. (2004) Biotechnol Bioeng 87:614-22). As another example, EP 1,176,195 by Hanai et al. describes a cell line with a functionally disrupted FUT8 gene, which encodes a fucosyl transferase, such that antibodies expressed in such a cell line exhibit hypofucosylation by reducing or eliminating the α 1,6 bond-related enzyme. Hanai et al. also describe cell lines which have a low enzyme activity for adding fucose to the N-acetylglucosamine that binds to the Fc region of the antibody or does not have the enzyme activity, for example the rat myeloma cell line YB2/0 (ATCC CRL 1662). PCT Publication WO 03/035835 by Presta describes a variant CHO cell line, Lec13 cells, with reduced ability to attach fucose to Asn(297)-linked carbohydrates, also resulting in hypofucosylation of antibodies expressed in that host cell (see also Shields, R. L. et al. (2002) J. Biol.

Chem. 277:26733-26740). PCT Publication WO 99/54342 by Umana et al. describes cell lines engineered to express glycoprotein-modifying glycosyl transferases (e.g., β(1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) *Nat. Biotech.* 17:176-180). Alternatively, the fucose residues of the antibody may be cleaved off using a fucosidase enzyme. For example, the fucosidase α-L-fucosidase removes fucosyl residues from antibodies (Tarentino, A. L. et al. (1975) *Biochem.* 14:5516-23).

Another modification of the antibodies herein that is contemplated by the invention is PEGylation or the addition of other water soluble moieties, typically polymers, e.g., in order to enhance half-life. An antibody can be PEGylated to, for example, increase the biological (e.g., serum) half-life of the antibody. To PEGylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. Preferably, the PEGylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono ($C_1$-$C_{10}$) alkoxy- or aryloxy-polyethylene glycol or polyethylene glycol-maleimide. In certain embodiments, the antibody to be PEGylated is an aglycosylated antibody. Methods for PEGylating proteins are known in the art and can be applied to the antibodies according to at least some embodiments of the invention. See for example, EP 0 154 316 by Nishimura et al. and EP 0 401 384 by Ishikawa et al.

In addition to substitutions made to alter binding affinity to FcγRs and/or FcRn and/or increase in vivo serum half-life, additional antibody modifications can be made, as described in further detail below.

In some cases, affinity maturation is done. Amino acid modifications in the CDRs are sometimes referred to as "affinity maturation". An "affinity matured" antibody is one having one or more alteration(s) in one or more CDRs which results in an improvement in the affinity of the antibody for antigen, compared to a parent antibody which does not possess those alteration(s). In some cases, it may be desirable to decrease the affinity of an antibody to its antigen.

In some embodiments, one or more amino acid modifications are made in one or more of the CDRs of the antibodies of the invention. In general, only 1 or 2 or 3-amino acids are substituted in any single CDR, and generally no more than from 1, 2, 3. 4, 5, 6, 7, 8 9 or 10 changes are made within a set of CDRs. However, it should be appreciated that any combination of no substitutions, 1, 2 or 3 substitutions in any CDR can be independently and optionally combined with any other substitution.

Affinity maturation can be done to increase the binding affinity of the antibody for the antigen by at least about 10% to 50-100-150% or more, or from 1 to 5 fold as compared to the "parent" antibody. Preferred affinity matured antibodies will have nanomolar or even picomolar affinities for the antigen. Affinity matured antibodies are produced by known procedures. See, for example, Marks et al., 1992, Biotechnology 10:779-783 that describes affinity maturation by variable heavy chain (VH) and variable light chain (VL) domain shuffling. Random mutagenesis of CDR and/or framework residues is described in: Barbas, et al. 1994, Proc. Nat. Acad. Sci, USA 91:3809-3813; Shier et al., 1995, Gene 169:147-155; Yelton et al., 1995, J. Immunol. 155: 1994-2004; Jackson et al., 1995, J. Immunol. 154(7):3310-9; and Hawkins et al, 1992, J. Mol. Biol. 226:889-896, for example.

Alternatively, amino acid modifications can be made in one or more of the CDRs of the antibodies of the invention that are "silent", e.g. that do not significantly alter the affinity of the antibody for the antigen. These can be made for a number of reasons, including optimizing expression (as can be done for the nucleic acids encoding the antibodies of the invention).

Thus, included within the definition of the CDRs and antibodies of the invention are variant CDRs and antibodies; that is, the antibodies of the invention can include amino acid modifications in one or more of the CDRs of the enumerated antibodies of the invention. In addition, as outlined below, amino acid modifications can also independently and optionally be made in any region outside the CDRs, including framework and constant regions.

VI. ANTI-TIGIT ANTIBODIES IN COMBINATION THERAPY

The TIGIT and PVRIG antibodies of the invention find particular use in the treatment of cancer when used in combination and for example with a checkpoint inhibitor such as an anti-PD-1 antibody, as described herein. In general, the antibodies of the invention are immunomodulatory, in that rather than directly attack cancerous cells, the anti-TIGIT and anti-PVRIG antibodies of the invention stimulate the immune system, generally by inhibiting the action of TIGIT and PVRIG, respectively. Thus, unlike tumor-targeted therapies, which are aimed at inhibiting molecular pathways that are crucial for tumor growth and development, and/or depleting tumor cells, cancer immunotherapy is aimed to stimulate the patient's own immune system to eliminate cancer cells, providing long-lived tumor destruction. Various approaches can be used in cancer immunotherapy, among them are therapeutic cancer vaccines to induce tumor-specific T cell responses, and immunostimulatory antibodies (i.e. antagonists of inhibitory receptors=immune checkpoints) to remove immunosuppressive pathways.

Clinical responses with targeted therapy or conventional anti-cancer therapies tend to be transient as cancer cells develop resistance, and tumor recurrence takes place. However, the clinical use of cancer immunotherapy in the past few years has shown that this type of therapy can have durable clinical responses, showing dramatic impact on long term survival. However, although responses are long term, only a small number of patients respond (as opposed to conventional or targeted therapy, where a large number of patients respond, but responses are transient).

By the time a tumor is detected clinically, it has already evaded the immune-defense system by acquiring immunoresistant and immunosuppressive properties and creating an immunosuppressive tumor microenvironment through various mechanisms and a variety of immune cells.

Accordingly, the anti-TIGIT and anti-PVRIG combinations of the invention are useful in treating cancer. Due to the nature of an immuno-oncology mechanism of action, TIGIT and or PVRIG do not necessarily need to be overexpressed on or correlated with a particular cancer type; that is, the goal is to have the anti-TIGIT antibodies de-suppress T cell and NK cell activation, such that the immune system will go after the cancers.

VII. NUCLEIC ACID COMPOSITIONS

Nucleic acid compositions encoding the anti-TIGIT, anti-PVRIG and anti-PD-1 antibodies of the invention are also provided, as well as expression vectors containing the nucleic acids and host cells transformed with the nucleic acid and/or expression vector compositions. As will be appreciated by those in the art, the protein sequences depicted herein can be encoded by any number of possible nucleic acid sequences, due to the degeneracy of the genetic code.

The nucleic acid compositions that encode the antibodies will depend on the format of the antibody. For traditional, tetrameric antibodies containing two heavy chains and two light chains are encoded by two different nucleic acids, one encoding the heavy chain and one encoding the light chain. These can be put into a single expression vector or two expression vectors, as is known in the art, transformed into host cells, where they are expressed to form the antibodies of the invention. In some embodiments, for example when scFv constructs are used, a single nucleic acid encoding the variable heavy chain-linker-variable light chain is generally used, which can be inserted into an expression vector for transformation into host cells. The nucleic acids can be put into expression vectors that contain the appropriate transcriptional and translational control sequences, including, but not limited to, signal and secretion sequences, regulatory sequences, promoters, origins of replication, selection genes, etc.

Preferred mammalian host cells for expressing the recombinant antibodies according to at least some embodiments of the invention include Chinese Hamster Ovary (CHO cells), PER.C6, HEK293 and others as is known in the art.

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art.

To create a scFv gene, the $V_H$- and $V_L$-encoding DNA fragments are operatively linked to another fragment encoding a flexible linker, e.g., encoding the amino acid sequence (Gly4-Ser)3 (SEQ ID NO: 1854), such that the $V_H$ and $V_L$ sequences can be expressed as a contiguous single-chain protein, with the $V_L$ and $V_H$ regions joined by the flexible linker (see e.g., Bird et al. (1988) *Science* 242:423-426; Huston et al. (1988) *Proc. Natl. Acad. Sci. USA* 85:5879-5883; McCafferty et al., (1990) *Nature* 348:552-554).

VIII. FORMULATIONS OF THE ANTIBODIES OF THE INVENTION

The therapeutic compositions used in the practice of the foregoing methods can be formulated into pharmaceutical compositions comprising a carrier suitable for the desired delivery method. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, Remington's Pharmaceutical Sciences 16$^{th}$ Edition, A. Osal., Ed., 1980). Acceptable carriers, excipients, or stabilizers are nontoxic to recipients at the dosages and concentrations employed and may include buffers.

In a preferred embodiment, the pharmaceutical composition that comprises the antibodies of the invention may be in a water-soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids and the like. "Pharmaceutically acceptable base addition salts" include those derived from inorganic bases and the like.

Administration of the pharmaceutical composition comprising antibodies of the present invention, preferably in the form of a sterile aqueous solution, may be done in a variety of ways, including, but not limited to subcutaneously and intravenously.

The dosing amounts and frequencies of administration are, in a preferred embodiment, selected to be therapeutically or prophylactically effective. As is known in the art, adjustments for protein degradation, systemic versus localized delivery, and rate of new protease synthesis, as well as the age, body weight, general health, sex, diet, time of administration, drug interaction and the severity of the condition may be necessary, and will be ascertainable with routine experimentation by those skilled in the art.

In order to treat a patient, a therapeutically effective dose of the Fc variant of the present invention may be administered. By "therapeutically effective dose" herein is meant a dose that produces the effects for which it is administered. The exact dose will depend on the purpose of the treatment, and will be ascertainable by one skilled in the art using known techniques.

A. Combination Formulations

The antibodies of the invention (either as a triple combination of anti-TIGIT, anti-PVRIG and anti-PD-1 antibodies or as a double combination of anti-TIGIT and anti-PVRIG antibodies) can be done in a variety of ways as those in the art will appreciate. In some cases, the antibodies are administered simultaneously, either as separate infusions (e.g. each IV bag holds a single antibody), for example, or as one infusion of a mixture of the antibodies. Alternatively, the antibodies can be administered sequentially, for example over a period of hours or days.

In some cases, the antibodies are provided in an administration kit, with dosage units of each antibody, again either packaged separately in individual dosage units, or together, as a mixture of antibodies as a single dosage unit.

IX. COMBINATION THERAPIES AND USES

A. Cancer Therapies

"Cancer," as used herein, refers broadly to any neoplastic disease (whether invasive or metastatic) characterized by abnormal and uncontrolled cell division causing malignant growth or tumor (e.g., unregulated cell growth.) The term "cancer" or "cancerous" as used herein should be understood to encompass any neoplastic disease (whether invasive, non-invasive or metastatic) which is characterized by abnormal and uncontrolled cell division causing malignant growth or tumor, non-limiting examples of which are described herein. This includes any physiological condition in mammals that is typically characterized by unregulated cell growth. Examples of cancer are exemplified in the working examples and also are described within the specification.

Non-limiting examples of cancer that can be treated using anti-TIGIT antibodies, anit-PVRIG antibodies, as well as combinations of anti-TIGIT antibodies and other antibodies, such as any of the anti-TIGIT, anit-PVRIG, anti-PD-1 and/or anti-PD-L1 antibodies as provided herein. Such cancers include, but are not limited to, carcinoma, lymphoma, blastoma, sarcoma, and leukemia. More particular examples of such cancers include squamous cell cancer, lung cancer (including small-cell lung cancer, non-small cell lung cancer, adenocarcinoma of the lung, and squamous carcinoma of the lung), cancer of the peritoneum, hepatocellular cancer, gastric or stomach cancer (including gastrointestinal cancer), esophageal cancer, melanoma, mesothelioma, merkel cell cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney or renal cancer, prostate cancer, vulval cancer, thyroid cancer, hepatic carcinoma and various types of head and neck cancer, larynx cancer, oral cavity cancer, urothelial cancer, KRAS mutant tumors, Myelodysplastic syndromes (MDS), as well as B-cell malignancies, B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenström's Macroglobulinemia); chronic lymphocytic leukemia (CLL); acute lymphoblastic leukemia (ALL); Hairy cell leukemia; chronic myeloblastic leukemia; adult T-cell leukemia/lymphoma; myeloma; multiple myeloma and posttransplant lymphoproliferative disorder (PTLD), lymphoid malignancies, abnormal vascular proliferation associated with phakomatoses, edema (such as that associated with brain tumors), and Meigs' syndrome, rectal cancer, renal cell cancer, soft-tissue sarcoma, Kaposi's sarcoma, carcinoid carcinoma, ovarian early or advanced (including metastatic). The cancerous conditions amenable for treatment of the invention include cancers that express or do not express TIGIT, PVRIG, PVRL, PD-1, and/or PD-L1, and further include non-metastatic or non-invasive as well as invasive or metastatic cancers wherein TIGIT, PVRIG, PVRL, PD-1, and/or PD-L1, expression by immune, stromal or diseased cells suppress antitumor responses and anti-invasive immune responses. The method of the present invention is particularly suitable for the treatment of vascularized tumors. In some embodiments, the cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS). In some embodiments of the method, the cancer is selected from the group consisting of cancer triple negative breast cancer, stomach (gastric) cancer, lung cancer (small cell lung, non-small cell lung), Merkel Cells cancer, MSI-high cancer, KRAS mutant tumors, adult T-cell leukemia/lymphoma, and Myelodysplastic syndromes (MDS).

"Cancer therapy" herein refers to any method which prevents or treats cancer or ameliorates one or more of the symptoms of cancer. Typically, such therapies will comprises administration of immunostimulatory anti-TIGIT and anti-PVRIG antibodies (including antigen-binding fragments) in combination with chemotherapy or radiotherapy or other biologics and for enhancing the activity thereof, i.e., in individuals wherein expression of TIGIT and or PVRIG suppresses antitumor responses and the efficacy of chemotherapy or radiotherapy or biologic efficacy.

The present invention provides combination therapies and uses of anti-TIGIT antibodies and anti-PVRIG antibodies, sometimes with the addition of anti-PD-1 antibodies, for a triple combination therapy. The present invention provides combination therapies and uses of anti-TIGIT antibodies and anti-PVRIG antibodies, sometimes with the addition of anti-PD-L1 antibodies. Any of the PVRIG antibodies listed above or in the figures can employed for a triple combination therapy. Any of the TIGIT antibodies listed above or in the figures can be employed for a triple combination therapy. Any of the PD-1 antibodies listed above or in the figures can employed for a triple combination therapy. Any of the PD-L1 antibodies listed above or in the figures can employed for a triple combination therapy. In some embodiments, the anti-TIGIT antibody is an antibody chosen from any anti-TIGIT antibody described herein, including any of those described in FIG. 3. In some embodiments, the anti-PVRIG antibody is an antibody chosen from any anti-PVRIG antibody described herein, including any of those described in FIG. 5 and/or FIG. 63. In some embodiments, the anti-PD-1 antibody is an antibody chosen from any anti-PD-1 antibody described herein, including any of those described in FIG. 7.

In some embodiments, the anti-PD-1 antibody is selected from pembrolizumab (Keytruda®; MK-3475-033), nivolumab (Opdivo®; CheckMate078), cemplimab (REGN2810), SHR-1210 (CTR20160175 and CTR20170090), SHR-1210 (CTR20170299 and CTR20170322), JS-001 (CTR20160274), IBI308 (CTR20160735), BGB-A317 (CTR20160872) and/or a PD-1 antibody as recited in U.S. Patent Publication No. 2017/0081409.

In some embodiments, the anti-PD-L1 antibody is selected from antibody is one described in U.S. Patent Publication No. 2017/0281764 as well as International Patent Publication No. WO 2013/079174 (avelumab) and WO 2010/077634 (or U.S. Patent Application No. 20160222117 or U.S. Pat. No. 8,217,149; atezolizumab). In some embodiments, the PD-L1 antibody comprises a heavy chain sequence of SEQ ID NO: 34 and a light chain sequence of SEQ ID NO: 36 (from US 2017/281764). In some embodiments, the PD-L1 antibody is atezolizumab (TECENTRIQ®; MPDL3280A; IMpower110). In some embodiments, the PD-L1 antibody is avelumab (BAVENCIO®; MSB001071 8C). In some embodiments, the PD-L1 antibody is durvalumab (MEDI4736). In some embodiments, the PD-L1 antibody includes, for example, Atezolizumab (IMpower133), BMS-936559/MDX-1105, and/or RG-7446/MPDL3280A, and/or YW243.55.S70, as well as any of those provided herein in FIG. 62.

In some embodiments, the anti-PVRIG antibody is selected from an antibody the sequences for which are shown in FIGS. 5 and/or 63:

CPA.7.001, CPA.7.001.VH, CPA.7.001.VL, CPA.7.001.HC, CPA.7.001.LC and CPA.7.001.H1, CPA.7.001.H2, CPA.7.001.H3, CPA.7.001.H4; CPA.7.001.vhCDR1, CPA.7.001.vhCDR2, CPA.7.001.vhCDR3, CPA.7.001.vlCDR1, CPA.7.001.vlCDR2, and CPA.7.001.vlCDR3;

CPA.7.003, CPA.7.003.VH, CPA.7.003.VL, CPA.7.003.HC, CPA.7.003.LC, CPA.7.003.H1, CPA.7.003.H2, CPA.7.003.H3, CPA.7.003.H4; CPA.7.003.vhCDR1, CPA.7.003.vhCDR2, CPA.7.003.vhCDR3, CPA.7.003.vlCDR1, CPA.7.003.vlCDR2, and CPA.7.003.vlCDR3;

CPA.7.004, CPA.7.004.VH, CPA.7.004.VL, CPA.7.004.HC, CPA.7.004.LC, CPA.7.004.H1, CPA.7.004.H2, CPA.7.004.H3 CPA.7.004.H4; CPA.7.004.vhCDR1, CPA.7.004.vhCDR2, CPA.7.004.vhCDR3, CPA.7.004.vlCDR1, CPA.7.004.vlCDR2, and CPA.7.004.vlCDR3;

CPA.7.006, CPA.7.006.VH, CPA.7.006.VL, CPA.7.006.HC, CPA.7.006.LC, CPA.7.006.H1, CPA.7.006.H2, CPA.7.006.H3 CPA.7.006.H4; CPA.7.006.vhCDR1, CPA.7.006.vhCDR2, CPA.7.006.vhCDR3, CPA.7.006.vlCDR1, CPA.7.006.vlCDR2, and CPA.7.006.vlCDR3;

CPA.7.008, CPA.7.008.VH, CPA.7.008.VL, CPA.7.008.HC, CPA.7.008.LC, CPA.7.008.H1, CPA.7.008.H2, CPA.7.008.H3 CPA.7.008.H4; CPA.7.008.vhCDR1, CPA.7.008.vhCDR2, CPA.7.008.vhCDR3, CPA.7.008.vlCDR1, CPA.7.008.vlCDR2, and CPA.7.008.vlCDR3;

CPA.7.009, CPA.7.009.VH, CPA.7.009.VL, CPA.7.009.HC, CPA.7.009.LC, CPA.7.009.H1, CPA.7.009.H2, CPA.7.009.H3 CPA.7.009.H4; CPA.7.009.vhCDR1, CPA.7.009.vhCDR2, CPA.7.009.vhCDR3, CPA.7.009.vlCDR1, CPA.7.009.vlCDR2, and CPA.7.009.vlCDR3;

CPA.7.010, CPA.7.010.VH, CPA.7.010.VL, CPA.7.010.HC, CPA.7.010.LC, CPA.7.010.H1, CPA.7.010.H2, CPA.7.010.H3 CPA.7.010.H4; CPA.7.01.vhCDR1, CPA.7.01.vhCDR2, CPA.7.01.vhCDR3, CPA.7.010.vlCDR1, CPA.7.010.vlCDR2, and CPA.7.010.vlCDR3;

CPA.7.011, CPA.7.011.VH, CPA.7.011.VL, CPA.7.011.HC, CPA.7.011.LC, CPA.7.011.H1, CPA.7.011.H2, CPA.7.011.H3 CPA.7.011.H4; CPA.7.011.vhCDR1, CPA.7.011.vhCDR2, CPA.7.011.vhCDR3, CPA.7.011.vlCDR1, CPA.7.011.vlCDR2, and CPA.7.011.vlCDR3;

CPA.7.012, CPA.7.012.VH, CPA.7.012.VL, CPA.7.012.HC, CPA.7.012.LC, CPA.7.012.H1, CPA.7.012.H2, CPA.7.012.H3 CPA.7.012.H4; CPA.7.012.vhCDR1, CPA.7.012.vhCDR2, CPA.7.012.vhCDR3, CPA.7.012.vlCDR1, CPA.7.012.vlCDR2, and CPA.7.012.vlCDR3;

CPA.7.013, CPA.7.013.VH, CPA.7.013.VL, CPA.7.013.HC, CPA.7.013.LC, CPA.7.013.H1, CPA.7.013.H2, CPA.7.013.H3 CPA.7.013.H4; CPA.7.013.vhCDR1, CPA.7.013.vhCDR2, CPA.7.013.vhCDR3, CPA.7.013.vlCDR1, CPA.7.013.vlCDR2, and CPA.7.013.vlCDR3;

CPA.7.014, CPA.7.014.VH, CPA.7.014.VL, CPA.7.014.HC, CPA.7.014.LC, CPA.7.014.H1, CPA.7.014.H2, CPA.7.014.H3 CPA.7.014.H4; CPA.7.014.vhCDR1, CPA.7.014.vhCDR2, CPA.7.014.vhCDR3, CPA.7.014.vlCDR1, CPA.7.014.vlCDR2, and CPA.7.014.vlCDR3;

CPA.7.015, CPA.7.015.VH, CPA.7.015.VL, CPA.7.015.HC, CPA.7.015.LC, CPA.7.015.H1, CPA.7.015.H2, CPA.7.015.H3 CPA.7.015.H4; CPA.7.015.vhCDR1, CPA.7.015.vhCDR2, CPA.7.015.vhCDR3, CPA.7.015.vlCDR1, CPA.7.015.vlCDR2, and CPA.7.015.vlCDR3;

CPA.7.017, CPA.7.017.VH, CPA.7.017.VL, CPA.7.017.HC, CPA.7.017.LC, CPA.7.017H1, CPA.7.017.H2, CPA.7.017.H3 CPA.7.017.H4; CPA.7.017.vhCDR1, CPA.7.000171.vhCDR2, CPA.7.017.vhCDR3, CPA.7.017.vlCDR1, CPA.7.017.vlCDR2, and CPA.7.017.vlCDR3;

CPA.7.018, CPA.7.018.VH, CPA.7.018.VL, CPA.7.018.HC, CPA.7.018.LC, CPA.7.018.H1, CPA.7.018.H2, CPA.7.018.H3 CPA.7.018.H4; CPA.7.017.vhCDR1, CPA.7.017.vhCDR2, CPA.7.017.vhCDR3, CPA.7.017.vlCDR1, CPA.7.017.vlCDR2, and CPA.7.017.vlCDR3;

CPA.7.019, CPA.7.019.VH, CPA.7.019.VL, CPA.7.019.HC, CPA.7.019.LC, CPA.7.019.H1, CPA.7.019.H2, CPA.7.019.H3 CPA.7.019.H4; CPA.7.019.vhCDR1, CPA.7.019.vhCDR2, CPA.7.019.vhCDR3, CPA.7.019.vlCDR1, CPA.7.019.vlCDR2, and CPA.7.019.vlCDR3;

CPA.7.021, CPA.7.021.VH, CPA.7.021.VL, CPA.7.021.HC, CPA.7.021.LC, CPA.7.021.H1, CPA.7.021.H2, CPA.7.021.H3 CPA.7.021.H4; CPA.7.021.vhCDR1, CPA.7.021.vhCDR2, CPA.7.021.vhCDR3, CPA.7.021.vlCDR1, CPA.7.021.vlCDR2, and CPA.7.021.vlCDR3;

CPA.7.022, CPA.7.022.VH, CPA.7.022.VL, CPA.7.022.HC, CPA.7.022.LC, CPA.7.022.H1, CPA.7.022.H2, CPA.7.022.H3 CPA.7.022.H4; CPA.7.022.vhCDR1, CPA.7.022.vhCDR2, CPA.7.002201.vhCDR3, CPA.7.022.vlCDR1, CPA.7.022.vlCDR2, and CPA.7.022.vlCDR3;

CPA.7.023, CPA.7.023.VH, CPA.7.023.VL, CPA.7.023.HC, CPA.7.023.LC, CPA.7.023.H1, CPA.7.023.H2, CPA.7.023.H3 CPA.7.023.H4; CPA.7.023.vhCDR1, CPA.7.023.vhCDR2, CPA.7.023.vhCDR3, CPA.7.023.vlCDR1, CPA.7.023.vlCDR2, and CPA.7.023.vlCDR3;

CPA.7.024, CPA.7.024.VH, CPA.7.024.VL, CPA.7.024.HC, CPA.7.024.LC, CPA.7.024.H1, CPA.7.024.H2, CPA.7.024.H3 CPA.7.024.H4; CPA.7.024.vhCDR1, CPA.7.024.vhCDR2, CPA.7.024.vhCDR3, CPA.7.024.vlCDR1, CPA.7.024.vlCDR2, and CPA.7.024.vlCDR3;

CPA.7.033, CPA.7.033.VH, CPA.7.033.VL, CPA.7.033.HC, CPA.7.033.LC, CPA.7.033.H1, CPA.7.033.H2, CPA.7.033.H3 CPA.7.033.H4; CPA.7.033.vhCDR1, CPA.7.033.vhCDR2, CPA.7.033.vhCDR3, CPA.7.033.vlCDR1, CPA.7.033.vlCDR2, and CPA.7.033.vlCDR3;

CPA.7.034, CPA.7.034.VH, CPA.7.034.VL, CPA.7.034.HC, CPA.7.034.LC, CPA.7.034.H1, CPA.7.034.H2, CPA.7.034.H3 CPA.7.034.H4; CPA.7.034.vhCDR1, CPA.7.034.vhCDR2, CPA.7.034.vhCDR3, CPA.7.034.vlCDR1, CPA.7.034.vlCDR2, and CPA.7.034.vlCDR3;

CPA.7.036, CPA.7.036.VH, CPA.7.036.VL, CPA.7.036.HC, CPA.7.036.LC, CPA.7.036.H1, CPA.7.036.H2, CPA.7.036.H3 CPA.7.036.H4; CPA.7.036.vhCDR1, CPA.7.036.vhCDR2, CPA.7.036.vhCDR3, CPA.7.036.vlCDR1, CPA.7.036.vlCDR2, and CPA.7.036.vlCDR3;

CPA.7.040, CPA.7.040.VH, CPA.7.040.VL, CPA.7.040.HC, CPA.7.040.LC, CPA.7.040.H1, CPA.7.040.H2, CPA.7.040.H3 and CPA.7.040.H4; CPA.7.040.vhCDR1, CPA.7.040.vhCDR2, CPA.7.040.vhCDR3, CPA.7.040.vlCDR1, CPA.7.040.vlCDR2, and CPA.7.040.vlCDR3;

CPA.7.046, CPA.7.046.VH, CPA.7.046.VL, CPA.7.046.HC, CPA.7.046.LC, CPA.7.046.H1, CPA.7.046.H2, CPA.7.046.H3 CPA.7.046.H4; CPA.7.046.vhCDR1, CPA.7.046.vhCDR2, CPA.7.046.vhCDR3, CPA.7.046.vlCDR1, CPA.7.046.vlCDR2, and CPA.7.046.vlCDR3;

CPA.7.047, CPA.7.047.VH, CPA.7.047.VL, CPA.7.047.HC, CPA.7.047.LC, CPA.7.047.H1, CPA.7.047.H2, CPA.7.047.H3 CPA.7.047.H4; CPA.7.047.vhCDR1, CPA.7.047.vhCDR2, CPA.7.047.vhCDR3, CPA.7.047.vlCDR1, CPA.7.004701.vlCDR2, and CPA.7.047.vlCDR3;

CPA.7.049, CPA.7.049.VH, CPA.7.049.VL, CPA.7.049.HC, CPA.7.049.LC, CPA.7.049.H1, CPA.7.049.H2, CPA.7.049.H3 CPA. 7.049.H4; CPA.7.049.vhCDR1, CPA.7.049.vhCDR2, CPA.7.049.vhCDR3, CPA.7.049.vlCDR1, CPA.7.049.vlCDR2, and CPA.7.049.vlCDR3; and CPA.7.050, CPA.7.050.VH, CPA.7.050.VL, CPA.7.050.HC, CPA.7.050.LC, CPA.7.050.H1, CPA.7.050.H2, CPA.7.050.H3 CPA.7.050.H4, CPA.7.050.vhCDR1, CPA.7.050.vhCDR2, CPA.7.050.vhCDR3, CPA.7.050.vlCDR1, CPA.7.050.vlCDR2, and CPA.7.050.vlCDR3.

CPA.7.028, CPA.7.028.VH, CPA.7.028.VL, CPA.7.028.HC, CPA.7.028.LC, CPA.7.028.H1, CPA.7.028.H2, CPA.7.028.H3 and CPA.7.028.H4; CPA.7.028.vhCDR1, CPA.7.028.vhCDR2, CPA.7.028.vhCDR3, CPA.7.028.vlCDR1, CPA.7.028.vlCDR2, and CPA.7.028.vlCDR3.

CPA.7.030, CPA.7.030.VH, CPA.7.030.VL, CPA.7.030.HC, CPA.7.030.LC, CPA.7.030.H1, CPA.7.030.H2, CPA.7.030.H3 and CPA.7.030.H4; CPA.7.030.vhCDR1, CPA.7.030.vhCDR2, CPA.7.030.vhCDR3, CPA.7.030.vlCDR1, CPA.7.030.vlCDR2, and CPA.7.030.vlCDR3.

CPA.7.041, CPA.7.041.VH, CPA.7.041.VL, CPA.7.041.HC, CPA.7.041.LC, CPA.7.041.H1, CPA.7.041.H2, CPA.7.041.H3 and CPA.7.041.H4; CPA.7.041.vhCDR1, CPA.7.041.vhCDR2, CPA.7.041.vhCDR3, CPA.7.041.vlCDR1, CPA.7.041.vlCDR2, and CPA.7.041.vlCDR3.

CPA.7.016, CPA.7.016.VH, CPA.7.016.VL, CPA.7.016.HC, CPA.7.016.LC, CPA.7.016.H1, CPA.7.016.H2, CPA.7.016.H3 and CPA.7.016.H4; CPA.7.016.vhCDR1, CPA.7.016.vhCDR2, CPA.7.016.vhCDR3, CPA.7.016.vlCDR1, CPA.7.016.vlCDR2, and CPA.7.016.vlCDR3.

CPA.7.020, CPA.7.020.VH, CPA.7.020.VL, CPA.7.020.HC, CPA.7.020.LC, CPA.7.020.H1, CPA.7.020.H2, CPA.7.020.H3 and CPA.7.020.H4; CPA.7.020.vhCDR1, CPA.7.020.vhCDR2, CPA.7.020.vhCDR3, CPA.7.020.vlCDR1, CPA.7.020.vlCDR2, and CPA.7.020.vlCDR3.

CPA.7.038, CPA.7.038.VH, CPA.7.038.VL, CPA.7.038.HC, CPA.7.038.LC, CPA.7.038.H1, CPA.7.038.H2, CPA.7.038.H3 and CPA.7.038.H4; CPA.7.038.vhCDR1, CPA.7.038.vhCDR2, CPA.7.038.vhCDR3, CPA.7.038.vlCDR1, CPA.7.038.vlCDR2, and CPA.7.038.vlCDR3.

CPA.7.044, CPA.7.044.VH, CPA.7.044.VL, CPA.7.044.HC, CPA.7.044.LC, CPA.7.044.H1, CPA.7.044.H2, CPA.7.044.H3 and CPA.7.044.H4; CPA.7.044.vhCDR1, CPA.7.044.vhCDR2, CPA.7.044.vhCDR3, CPA.7.044.vlCDR1, CPA.7.044.vlCDR2, and CPA.7.044.vlCDR3.

CPA.7.045, CPA.7.045.VH, CPA.7.045.VL, CPA.7.045.HC, CPA.7.045.LC, CPA.7.045.H1, CPA.7.045.H2, CPA.7.045.H3 and CPA.7.045.H4; CPA.7.045.vhCDR1, CPA.7.045.vhCDR2, CPA.7.045.vhCDR3, CPA.7.045.vlCDR1, CPA.7.045.vlCDR2, and CPA.7.045.vlCDR3.

In some embodiments, the anti-TIGIT antibody is selected from an antibody the sequences for which are shown in FIG. 3:

CPA.9.018, CPA.9.018.VH, CPA.9.018.VL, CPA.9.018.HC, CPA.9.018.LC, CPA.9.018.H1, CPA.9.018.H2, CPA.9.018.H3, CPA.9.018.H4; CPA.9.018.H4(S241P); CPA.9.018.vhCDR1, CPA.9.018.vhCDR2, CPA.9.018.vhCDR3, CPA.9.018.vlCDR1, CPA.9.018.vlCDR2, CPA.9.018.vlCDR3 and scFv-CPA.9.018;

CPA.9.027, CPA.9.027.VH, CPA.9.027.VL, CPA.9.027.HC, CPA.9.027.LC, CPA.9.027.H1, CPA.9.027.H2, CPA.9.027.H3, CPA.9.027.H4; CPA.9.018.H4(S241P); CPA.9.027.vhCDR1, CPA.9.027.vhCDR2, CPA.9.027.vhCDR3, CPA.9.027.vlCDR1, CPA.9.027.vlCDR2, CPA.9.027.vlCDR3 and scFv-CPA.9.027;

CPA.9.049, CPA.9.049.VH, CPA.9.049.VL, CPA.9.049.HC, CPA.9.049.LC, CPA.9.049.H1, CPA.9.049.H2, CPA.9.049.H3; CPA.9.049.H4; CPA.9.049.H4(S241P); CPA.9.049.vhCDR1, CPA.9.049.vhCDR2, CPA.9.049.vhCDR3, CPA.9.049.vlCDR1, CPA.9.049.vlCDR2, CPA.9.049.vlCDR3 and scFv-CPA.9.049;

CPA.9.057, CPA.9.057.VH, CPA.9.057.VL, CPA.9.057.HC, CPA.9.057.LC, CPA.9.057.H1, CPA.9.057.H2, CPA.9.057.H3; CPA.9.057.H4; CPA.9.057.H4(S241P); CPA.9.057.vhCDR1, CPA.9.057.vhCDR2, CPA.9.057.vhCDR3, CPA.9.057.vlCDR1, CPA.9.057.vlCDR2, CPA.9.057.vlCDR3 and scFv-CPA.9.057;

CPA.9.059, CPA.9.059.VH, CPA.9.059.VL, CPA.9.059.HC, CPA.9.059.LC, CPA.9.059.H1, CPA.9.059.H2, CPA.9.059.H3; CPA.9.059.H4; CPA.9.059.H4(S241P); CPA.9.059.vhCDR1, CPA.9.059.vhCDR2, CPA.9.059.vhCDR3, CPA.9.059.vlCDR1, CPA.9.059.vlCDR2, CPA.9.059.vlCDR3 and scFv-CPA.9.059;

CPA.9.083, CPA.9.083.VH, CPA.9.083.VL, CPA.9.083.HC, CPA.9.083.LC, CPA.9.083.H1, CPA.9.083.H2, CPA.9.083.H3; CPA.9.083.H4; CPA.9.083.H4(S241P); CPA.9.083.vhCDR1, CPA.9.083.vhCDR2, CPA.9.083.vhCDR3, CPA.9.083.vlCDR1, CPA.9.083.vlCDR2, CPA.9.083.vlCDR3 and scFv-CPA.9.083;

CPA.9.086, CPA.9.086.VH, CPA.9.086.VL, CPA.9.086.HC, CPA.9.086.LC, CPA.9.086.H1, CPA.9.086.H2, CPA.9.086.H3; CPA.9.086.H4; CPA.9.086.H4(S241P); CPA.9.086.vhCDR1, CPA.9.086.vhCDR2, CPA.9.086.vhCDR3, CPA.9.086.vlCDR1, CPA.9.086.vlCDR2, CPA.9.086.vlCDR3 and scFv-CPA.9.086;

CPA.9.089, CPA.9.089.VH, CPA.9.089.VL, CPA.9.089.HC, CPA.9.089.LC, CPA.9.089.H1, CPA.9.089.H2, CPA.9.089.H3; CPA.9.089.H4;

CPA.9.089.H4(S241P); CPA.9.089.vhCDR1, CPA.9.089.vhCDR2, CPA.9.089.vhCDR3, CPA.9.089.vlCDR1, CPA.9.089.vlCDR2, CPA.9.089.vlCDR3 and scFv-CPA.9.089;

CPA.9.093, CPA.9.093.VH, CPA.9.093.VL, CPA.9.093.HC, CPA.9.093.LC, CPA.9.093.H1, CPA.9.093.H2, CPA.9.093.H3; CPA.9.093.H4; CPA.9.093.H4(S241P); CPA.9.093.vhCDR1, CPA.9.093.vhCDR2, CPA.9.093.vhCDR3, CPA.9.093.vlCDR1, CPA.9.093.vlCDR2, CPA.9.093.vlCDR3 and scFv-CPA.9.093;

CPA.9.101, CPA.9.101.VH, CPA.9.101.VL, CPA.9.101.HC, CPA.9.101.LC, CPA.9.101.H1, CPA.9.101.H2, CPA.9.101.H3; CPA.9.101.H4; CPA.9.101.H4(S241P); CPA.9.101.vhCDR1, CPA.9.101.vhCDR2, CPA.9.101.vhCDR3, CPA.9.101.vlCDR1, CPA.9.101.vlCDR2, CPA.9.101.vlCDR3 and scFv-CPA.9.101; and CPA.9.103, CPA.9.103.VH, CPA.9.103.VL, CPA.9.103.HC, CPA.9.103.LC, CPA.9.103.H1, CPA.9.103.H2, CPA.9.103.H3; CPA.9.103.H4; CPA.9.103.H4(S241P); CPA.9.103.vhCDR1, CPA.9.103.vhCDR2, CPA.9.103.vhCDR3, CPA.9.103.vlCDR1, CPA.9.103.vlCDR2, CPA.9.103.vlCDR3 and scFv-CPA.9.103.

CHA.9.536.1, CHA.9.536.1.VH, CHA.9.536.1.VL, CHA.9.536.1.HC, CHA.9.536.1.LC, CHA.9.536.1.H1, CHA.9.536.1.H2, CHA.9.536.1.H3; CHA.9.536.1.H4, CHA.9.536.1.H4(S241P), CHA.9.536.1.vhCDR1, CHA.9.536.1.vhCDR2, CHA.9.536.1.vhCDR3, CHA.9.536.1.vlCDR1, CHA.9.536.1.vlCDR2 and CHA.9.536.1.vhCDR3;

CHA.9.536.3, CHA.9.536.3.VH, CHA.9.536.3.VL, CHA.9.536.3.HC, CHA.9.536.3.LC, CHA.9.536.3.H1, CHA.9.536.3.H2, CHA.9.536.3.H3; CHA.9.536.3.H4, CHA.9.536.3.H4(S241P); CHA.9.536.3.vhCDR1, CHA.9.536.3.vhCDR2, CHA.9.536.3.vhCDR3, CHA.9.536.3.vlCDR1, CHA.9.536.3.vlCDR2 and CHA.9.536.3.vhCDR3;

CHA.9.536.4, CHA.9.536.4.VH, CHA.9.536.4.VL, CHA.9.536.4.HC, CHA.9.536.4.LC, CHA.9.536.4.H1, CHA.9.536.4.H2, CHA.9.536.4.H3; CHA.9.536.4.H4, CHA.9.536.4.H4(S241P), CHA.9.536.4.vhCDR1, CHA.9.536.4.vhCDR2, CHA.9.536.4.vhCDR3, CHA.9.536.4.vlCDR1, CHA.9.536.4.vlCDR2 and CHA.9.536.4.vhCDR3;

CHA.9.536.5, CHA.9.536.5.VH, CHA.9.536.5.VL, CHA.9.536.5.HC, CHA.9.536.5.LC, CHA.9.536.5.H1, CHA.9.536.5.H2, CHA.9.536.5.H3; CHA.9.536.5.H4, CHA.9.536.5.H4(S241P), CHA.9.536.5.vhCDR1, CHA.9.536.5.vhCDR2, CHA.9.536.5.vhCDR3, CHA.9.536.5.vlCDR1, CHA.9.536.5.vlCDR2 and CHA.9.536.5.vhCDR3;

CHA.9.536.6, CHA.9.536.6.VH, CHA.9.536.6.VL, CHA.9.536.6.HC, CHA.9.536.6.LC, CHA.9.536.6.H1, CHA.9.536.6.H2, CHA.9.536.6.H3; CHA.9.536.6.H4, CHA.9.536.6.vhCDR1, CHA.9.536.6.vhCDR2, CHA.9.536.6.vhCDR3, CHA.9.536.6.vlCDR1, CHA.9.536.6.vlCDR2 and CHA.9.536.6.vhCDR3;

CHA.9.536.7, CHA.9.536.7.VH, CHA.9.536.7.VL, CHA.9.536.7.HC, CHA.9.536.7.LC, CHA.9.536.7.H1, CHA.9.536.7.H2, CHA.9.536.7.H3; CHA.9.536.7.H4, CHA.9.536.7.H4(S241P); CHA.9.536.7.vhCDR1, CHA.9.536.7.vhCDR2, CHA.9.536.7.vhCDR3, CHA.9.536.7.vlCDR1, CHA.9.536.7.vlCDR2 and CHA.9.536.7.vhCDR3;

CHA.9.536.8, CHA.9.536.8.VH, CHA.9.536.8.VL, CHA.9.536.8.HC, CHA.9.536.8.LC, CHA.9.536.8.H1, CHA.9.536.8.H2, CHA.9.536.8.H3; CHA.9.536.8.H4, CHA.9.536.8.H4(S241P), CHA.9.536.8.vhCDR1, CHA.9.536.8.vhCDR2, CHA.9.536.8.vhCDR3, CHA.9.536.8.vlCDR1, CHA.9.536.8.vlCDR2 and CHA.9.536.8.vhCDR3;

CHA.9.560.1, CHA.9.560.1VH, CHA.9.560.1.VL, CHA.9.560.1.HC, CHA.9.560.1.LC, CHA.9.560.1.H1, CHA.9.560.1.H2, CHA.9.560.1.H3; CHA.9.560.1.H4, CHA.9.560.1.H4(S241P), CHA.9.560.1.vhCDR1, CHA.9.560.1.vhCDR2, CHA.9.560.1.vhCDR3, CHA.9.560.1.vlCDR1, CHA.9.560.1.vlCDR2 and CHA.9.560.1.vhCDR3;

CHA.9.560.3, CHA.9.560.3VH, CHA.9.560.3.VL, CHA.9.560.3.HC, CHA.9.560.3.LC, CHA.9.560.3.H1, CHA.9.560.3.H2, CHA.9.560.3.H3; CHA.9.560.3.H4, CHA.9.560.3.H4(S241P); CHA.9.560.3.vhCDR1, CHA.9.560.3.vhCDR2, CHA.9.560. 3.vhCDR3, CHA.9.560.3.vlCDR1, CHA.9.560.3.vlCDR2 and CHA.9.560.3.vhCDR3;

CHA.9.560.4, CHA.9.560.4VH, CHA.9.560.4.VL, CHA.9.560.4.HC, CHA.9.560.4.LC, CHA.9.560.4.H1, CHA.9.560.4.H2, CHA.9.560.4.H3; CHA.9.560.4.H4, CHA.9.560.4.H4(S241P), CHA.9.560.4.vhCDR1, CHA.9.560.4.vhCDR2, CHA.9.560. 4.vhCDR3, CHA.9.560.4.vlCDR1, CHA.9.560.4.vlCDR2 and CHA.9.560.4.vhCDR3;

CHA.9.560.5, CHA.9.560.5VH, CHA.9.560.5.VL, CHA.9.560.5.HC, CHA.9.560.5.LC, CHA.9.560.5.H1, CHA.9.560.5.H2, CHA.9.560.5.H3; CHA.9.560.5.H4, CHA.9.560. 5.vhCDR1, CHA.9.560.5.vhCDR2, CHA.9.560.5.vhCDR3, CHA.9.560.5.vlCDR1, CHA. 9.560.5.vlCDR2 and CHA.9.560.5.vhCDR3;

CHA.9.560.6, CHA.9.560.6VH, CHA.9.560.6.VL, CHA.9.560.6.HC, CHA.9.560.6.LC, CHA.9.560.6.H1, CHA.9.560.6.H2, CHA.9.560.6.H3; CHA.9.560.6.H4, CHA.9.560.6.H4(S241P), CHA.9.560.6.vhCDR1, CHA.9.560.6.vhCDR2, CHA.9.560. 6.vhCDR3, CHA.9.560.6.vlCDR1, CHA.9.560.6.vlCDR2 and CHA.9.560.6.vhCDR3;

CHA.9.560.7, CHA.9.560.7VH, CHA.9.560.7.VL, CHA.9.560.7.HC, CHA.9.560.7.LC, CHA.9.560.7.H1, CHA.9.560.7.H2, CHA.9.560.7.H3; CHA.9.560.7.H4; CHA.9.560.7.H4(S241P); CHA.9.560.7.vhCDR1, CHA.9.560.7.vhCDR2, CHA.9.560. 7.vhCDR3, CHA.9.560.7.vlCDR1, CHA.9.560.7.vlCDR2 and CHA.9.560.7.vhCDR3;

CHA.9.560.8, CHA.9.560.8VH, CHA.9.560.8.VL, CHA.9.560.8.HC, CHA.9.560.8.LC, CHA.9.560.8.H1, CHA.9.560.8.H2, CHA.9.560.8.H3; CHA.9.560.8.H4, CHA.9.560.8.H4(S241P); CHA.9.560.8.vhCDR1, CHA.9.560.8.vhCDR2, CHA.9.560. 8.vhCDR3, CHA.9.560.8.vlCDR1, CHA.9.560.8.vlCDR2 and CHA.9.560.8.vhCDR3;

CHA.9.546.1, CHA.9.546.1VH, CHA.9.546.1.VL, CHA.9.546.1.HC, CHA.9.546.1.LC, CHA.9.546.1.H1, CHA.9.546.1.H2, CHA.9.546.1.H3; CHA.9.546.1.H4, CHA.9.546.1.H4(S241P), CHA.9.546.1.vhCDR1, CHA.9.546.1.vhCDR2, CHA.9. 546.1.vhCDR3, CHA.9.546.1.vlCDR1, CHA.9.546.1.vlCDR2 and CHA.9.546.1.vhCDR3;

CHA.9.547.1, CHA.9.547.1VH, CHA.9.547.1.VL, CHA.9.547.1.HC, CHA.9.547.1.LC, CHA.9.547.1.H1, CHA.9.547.1.H2, CHA.9.547.1.H3; CHA.9.547.1.H4, CHA.9.547.1.H4(S241P), CHA.9.547.1.vhCDR1,

CHA.9.547.1.vhCDR2, CHA.9.547.1.vhCDR3, CHA.9.547.1.vlCDR1, CHA.9.547.1.vlCDR2 and CHA.9.547.1.vhCDR3;

CHA.9.547.2, CHA.9.547.2VH, CHA.9.547.2.VL, CHA.9.547.2.HC, CHA.9.547.2.LC, CHA.9.547.2.H1, CHA.9.547.2.H2, CHA.9.547.2.H3; CHA.9.547.2.H4, CHA.9.547.2.H4(S241P), CHA.9.547.2.vhCDR1, CHA.9.547.2.vhCDR2, CHA.9.547.2.vhCDR3, CHA.9.547.2.vlCDR1, CHA.9.547.2.vlCDR2 and CHA.9.547.2.vhCDR3;

CHA.9.547.3, CHA.9.547.3VH, CHA.9.547.3.VL, CHA.9.547.3.HC, CHA.9.547.3.LC, CHA.9.547.3.H1, CHA.9.547.3.H2, CHA.9.547.3.H3; CHA.9.547.3.H4, CHA.9.547.3.H4(S241P), CHA.9.547.3.vhCDR1, CHA.9.547.3.vhCDR2, CHA.9.547.3.vhCDR3, CHA.9.547.3.vlCDR1, CHA.9.547.3.vlCDR2 and CHA.9.547.3.vhCDR3;

CHA.9.547.4, CHA.9.547.4VH, CHA.9.547.4.VL, CHA.9.547.4.HC, CHA.9.547.4.LC, CHA.9.547.4.H1, CHA.9.547.4.H2, CHA.9.547.4.H3; CHA.9.547.4.H4, CHA.9.547.4.H4(S241P), CHA.9.547.4.vhCDR1, CHA.9.547.4.vhCDR2, CHA.9.547.4.vhCDR3, CHA.9.547.4.vlCDR1, CHA.9.547.4.vlCDR2 and CHA.9.547.4.vhCDR3;

CHA.9.547.6, CHA.9.547.6 VH, CHA.9.547.6.VL, CHA.9.547.6.HC, CHA.9.547.6.LC, CHA.9.547.6.H1, CHA.9.547.6.H2, CHA.9.547.6.H3; CHA.9.547.6.H4, CHA.9.547.6.H4(S241P), CHA.9.547.6.vhCDR1, CHA.9.547.6.vhCDR2, CHA.9.547.6.vhCDR3, CHA.9.547.6.vlCDR1, CHA.9.547.6.vlCDR2 and CHA.9.547.6.vhCDR3;

CHA.9.547.7, CHA.9.547.7VH, CHA.9.547.7.VL, CHA.9.547.7.HC, CHA.9.547.7.LC, CHA.9.547.7.H1, CHA.9.547.7.H2, CHA.9.547.7.H3; CHA.9.547.7.H4, CHA.9.547.7.H4(S241P), CHA.9.547.7.vhCDR1, CHA.9.547.7.vhCDR2, CHA.9.547.7.vhCDR3, CHA.9.547.7.vlCDR1, CHA.9.547.7.vlCDR2 and CHA.9.547.7.vhCDR3;

CHA.9.547.8, CHA.9.547.8VH, CHA.9.547.8.VL, CHA.9.547.8.HC, CHA.9.547.8.LC, CHA.9.547.8.H1, CHA.9.547.8.H2, CHA.9.547.8.H3; CHA.9.547.8.H4, CHA.9.547.8.H4(S241P), CHA.9.547.8.vhCDR1, CHA.9.547.8.vhCDR2, CHA.9.547.8.vhCDR3, CHA.9.547.8.vlCDR1, CHA.9.547.8.vlCDR2 and CHA.9.547.8.vhCDR3;

CHA.9.547.9, CHA.9.547.9, CHA.9.547.9VH, CHA.9.547.9.VL, CHA.9.547.9.HC, CHA.9.547.9.LC, CHA.9.547.9.H1, CHA.9.547.9.H2, CHA.9.547.9.H3; CHA.9.547.9.H4, CHA.9.547.9.H4, CHA.9.547.9.H4(S241P), CHA.9.547.9.H4(S241P), CHA.9.547.9.vhCDR1, CHA.9.547.9.vhCDR2, CHA.9.547.9.vhCDR3, CHA.9.547.9.vlCDR1, CHA.9.547.9.vlCDR2 and CHA.9.547.9.vhCDR3;

CHA.9.547.13, CHA.9.547.13, CHA.9.547.13VH, CHA.9.547.13.VL, CHA.9.547.13.HC, CHA.9.547.13.LC, CHA.9.547.13.H1, CHA.9.547.13.H2, CHA.9.547.13.H3; CHA.9.547.13.H4, CHA.9.547.13.H4, CHA.9.547.13.H4(S241P), CHA.9.547.13.H4(S241P), CHA.9.547.13.vhCDR1, CHA.9.547.13.vhCDR2, CHA.9.547.13.vhCDR3, CHA.9.547.13.vlCDR1, CHA.9.547.13.vlCDR2 and CHA.9.547.13.vhCDR3;

CHA.9.541.1, CHA.9.541.1.VH, CHA.9.541.1.VL, CHA.9.541.1.HC, CHA.9.541.1.LC, CHA.9.541.1.H1, CHA.9.541.1.H2, CHA.9.541.1.H3; CHA.9.541.1.H4, CHA.9.541.1.H4(S241P), CHA.9.541.1.vhCDR1, CHA.9.541.1.vhCDR2, CHA.9.541.1.vhCDR3, CHA.9.541.1.vlCDR1, CHA.9.541.1.vlCDR2 and CHA.9.541.1.vhCDR3;

CHA.9.541.3, CHA.9.541.3.VH, CHA.9.541.3.VL, CHA.9.541.3.HC, CHA.9.541.3.LC, CHA.9.541.3.H1, CHA.9.541.3.H2, CHA.9.541.3.H3; CHA.9.541.3.H4, CHA.9.541.3.H4(S241P), CHA.9.541.3.vhCDR1, CHA.9.541.3.vhCDR2, CHA.9.541.3.vhCDR3, CHA.9.541.3.vlCDR1, CHA.9.541.3.vlCDR2 and CHA.9.541.3.vhCDR3;

CHA.9.541.4, CHA.9.541.4.VH, CHA.9.541.4.VL, CHA.9.541.4.HC, CHA.9.541.4.LC, CHA.9.541.4.H1, CHA.9.541.4.H2, CHA.9.541.4.H3; CHA.9.541.4.H4, CHA.9.541.4.H4(S241P), CHA.9.541.4.vhCDR1, CHA.9.541.4.vhCDR2, CHA.9.541.4.vhCDR3, CHA.9.541.4.vlCDR1, CHA.9.541.4.vlCDR2 and CHA.9.541.4.vhCDR3;

CHA.9.541.5, CHA.9.541.5.VH, CHA.9.541.5.VL, CHA.9.541.5.HC, CHA.9.541.5.LC, CHA.9.541.5.H1, CHA.9.541.5.H2, CHA.9.541.5.H3; CHA.9.541.5.H4, CHA.9.541.5.H4(S241P), CHA.9.541.5.vhCDR1, CHA.9.541.5.vhCDR2, CHA.9.541.5.vhCDR3, CHA.9.541.5.vlCDR1, CHA.9.541.5.vlCDR2 and CHA.9.541.5.vhCDR3;

CHA.9.541.6, CHA.9.541.6.VH, CHA.9.541.6.VL, CHA.9.541.6.HC, CHA.9.541.6.LC, CHA.9.541.6.H1, CHA.9.541.6.H2, CHA.9.541.6.H3; CHA.9.541.6.H4, CHA.9.541.6.H4(S241P), CHA.9.541.6.vhCDR1, CHA.9.541.6.vhCDR2, CHA.9.541.6.vhCDR3, CHA.9.541.6.vlCDR1, CHA.9.541.6.vlCDR2 and CHA.9.541.6.vhCDR3;

CHA.9.541.7, CHA.9.541.7.VH, CHA.9.541.7.VL, CHA.9.541.7.HC, CHA.9.541.7.LC, CHA.9.541.7.H1, CHA.9.541.7.H2, CHA.9.541.7.H3; CHA.9.541.7.H4, CHA.9.541.7.H4(S241P), CHA.9.541.7.vhCDR1, CHA.9.541.7.vhCDR2, CHA.9.541.7.vhCDR3, CHA.9.541.7.vlCDR1, CHA.9.541.7.vlCDR2 and CHA.9.541.7.vhCDR3; and CHA.9.541.8, CHA.9.541.8.VH, CHA.9.541.8.VL, CHA.9.541.8.HC, CHA.9.541.8.LC, CHA.9.541.8.H1, CHA.9.541.8.H2, CHA.9.541.8.H3; CHA.9.541.8.H4, CHA.9.541.8.H4(S241P); CHA.9.541.8vhCDR1, CHA.9.541.8.vhCDR2, CHA.9.541.8.vhCDR3, CHA.9.541.8.vlCDR1, CHA.9.541.8.vlCDR2 and CHA.9.541.8.vhCDR3.

In some embodiments, the anti-TIGIT antibody is CPA.9.083.H4(S241P), the anti-PD-1 antibody is pembrolizumab, and the anti-PVRIG antibody is one of the above and/or from FIG. 5 or 63.

In some embodiments, the anti-TIGIT antibody is CPA.9.086.H4(S241P), the anti-PD-1 antibody is pembrolizumab, and the anti-PVRIG antibody is one of the above and/or from FIG. 5 or 63.

In some embodiments, the anti-TIGIT antibody is CHA.9.547.7.H4(S241P), the anti-PD-1 antibody is pembrolizumab, and the anti-PVRIG antibody is one of the above and/or from FIG. 5 or 63.

In some embodiments, the anti-TIGIT antibody is CHA.9.547.13.H4(S241P), the anti-PD-1 antibody is pembrolizumab, and the anti-PVRIG antibody is one of the above and/or from FIG. 5 or 63.

In some embodiments, the anti-TIGIT antibody is CPA.9.083.H4(S241P), the anti-PD-1 antibody is nivolumab, and the anti-PVRIG antibody is one of the above and/or from FIG. 5 or 63.

In some embodiments, the anti-TIGIT antibody is CPA.9.086.H4(S241P), the anti-PD-1 antibody is nivolumab, and the anti-PVRIG antibody is one of the above and/or from FIG. 5 or 63.

In some embodiments, the anti-TIGIT antibody is CHA.9.547.7.H4(S241P), the anti-PD-1 antibody is nivolumab, and the anti-PVRIG antibody is one of the above and/or from FIG. 5 or 63.

In some embodiments, the anti-TIGIT antibody is CHA.9.547.13.H4(S241P), the PD-1 antibody is nivolumab, and the anti-PVRIG antibody is one of the above and/or from FIG. 5 or 63.

In some embodiments, the anti-TIGIT antibody is CPA.9.083.H4(S241P), the anti-PD-1 antibody is cemiplimab, and the anti-PVRIG antibody is one of the above and/or from FIG. 5 or 63.

In some embodiments, the anti-TIGIT antibody is CPA.9.086.H4(S241P), the anti-PD-1 antibody is cemiplimab, and the anti-PVRIG antibody is one of the above and/or from FIG. 5 or 63.

In some embodiments, the anti-TIGIT antibody is CHA.9.547.7.H4(S241P), the anti-PD-1 antibody is cemiplimab, and the anti-PVRIG antibody is one of the above and/or from FIG. 5 or 63.

In some embodiments, the anti-TIGIT antibody is CHA.9.547.13.H4(S241P), the PD-1 antibody is cemiplimab, and the anti-PVRIG antibody is one of the above and/or from FIG. 5 or 63.

In some embodiments, the anti-PVRIG antibody is CHA.7.518.1.H4(S241P), the anti-PD-1 antibody is pembrolizumab, and the anti-TIGIT antibody one of the above and/or from FIG. 3.

In some embodiments, the anti-PVRIG antibody is CHA.7.538.1.2.H4(S241P), the anti-PD-1 antibody is pembrolizumab, and the anti-TIGIT antibody one of the above and/or from FIG. 3.

In some embodiments, the anti-PVRIG antibody is CHA.7.518.1.H4(S241P), the anti-PD-1 antibody is nivolumab, and the anti-TIGIT antibody one of the above and/or from FIG. 3.

In some embodiments, the anti-PVRIG antibody is CHA.7.538.1.2.H4(S241P), the anti-PD-1 antibody is nivolumab, and the anti-TIGIT antibody one of the above and/or from FIG. 3.

In some embodiments, the anti-PVRIG antibody is CHA.7.518.1.H4(S241P), the anti-PD-1 antibody is cemiplimab, and the anti-TIGIT antibody one of the above and/or from FIG. 3.

In some embodiments, the anti-PVRIG antibody is CHA.7.538.1.2.H4(S241P), the anti-PD-1 antibody is cemiplimab, and the anti-TIGIT antibody one of the above and/or from FIG. 3.

In some embodiments, the anti-TIGIT antibody is CPA.9.083.H4(S241P), the anti-PVRIG antibody is CHA.7.538.1.2.H4(S241P), and the anti-PD-1 antibody is pembrolizumab.

In some embodiments, the anti-TIGIT antibody is CPA.9.083.H4(S241P), the anti-PVRIG antibody is CHA.7.518.1.H4(S241P), and the anti-PD-1 antibody is pembrolizumab.

In some embodiments, the anti-TIGIT antibody is CPA.9.086.H4(S241P), the anti-PVRIG antibody is CHA.7.538.1.2.H4(S241P), and the anti-PD-1 antibody is pembrolizumab.

In some embodiments, the anti-TIGIT antibody is CPA.9.086.H4(S241P), the anti-PVRIG antibody is CHA.7.518.1.H4(S241P), and the anti-PD-1 antibody is pembrolizumab.

In some embodiments, the anti-TIGIT antibody is CHA.9.547.7.H4(S241P), the anti-PVRIG antibody is CHA.7.538.1.2.H4(S241P), and the anti-PD-1 antibody is pembrolizumab.

In some embodiments, the anti-TIGIT antibody is CHA.9.547.7.H4(S241P), the anti-PVRIG antibody is CHA.7.518.1.H4(S241P), and the anti-PD-1 antibody is pembrolizumab.

In some embodiments, the anti-TIGIT antibody is CHA.9.547.13.H4(S241P), the anti-PVRIG antibody is CHA.7.538.1.2.H4(S241P), and the anti-PD-1 antibody is pembrolizumab.

In some embodiments, the anti-TIGIT antibody is CHA.9.547.13.H4(S241P), the anti-PVRIG antibody is CHA.7.518.1.H4(S241P), and the anti-PD-1 antibody is pembrolizumab.

In some embodiments, the anti-TIGIT antibody is CPA.9.083.H4(S241P), the anti-PVRIG antibody is CHA.7.538.1.2.H4(S241P), and the anti-PD-1 antibody is SHR-1210.

In some embodiments, the anti-TIGIT antibody is CPA.9.083.H4(S241P), the anti-PVRIG antibody is CHA.7.518.1.H4(S241P), and the anti-PD-1 antibody is SHR-1210.

In some embodiments, the anti-TIGIT antibody is CPA.9.086.H4(S241P), the anti-PVRIG antibody is CHA.7.538.1.2.H4(S241P), and the anti-PD-1 antibody is SHR-1210.

In some embodiments, the anti-TIGIT antibody is CPA.9.086.H4(S241P), the anti-PVRIG antibody is CHA.7.518.1.H4(S241P), and the anti-PD-1 antibody is SHR-1210.

In some embodiments, the anti-TIGIT antibody is CHA.9.547.7.H4(S241P), the anti-PVRIG antibody is CHA.7.538.1.2.H4(S241P), and the anti-PD-1 antibody is SHR-1210.

In some embodiments, the anti-TIGIT antibody is CHA.9.547.7.H4(S241P), the anti-PVRIG antibody is CHA.7.518.1.H4(S241P), and the anti-PD-1 antibody is SHR-1210.

In some embodiments, the anti-TIGIT antibody is CHA.9.547.13.H4(S241P), the anti-PVRIG antibody is CHA.7.538.1.2.H4(S241P), and the anti-PD-1 antibody is SHR-1210.

In some embodiments, the anti-TIGIT antibody is CHA.9.547.13.H4(S241P), the anti-PVRIG antibody is CHA.7.518.1.H4(S241P), and the anti-PD-1 antibody is SHR-1210.

In some embodiments, the anti-TIGIT antibody is CPA.9.083.H4(S241P), the anti-PVRIG antibody is CHA.7.538.1.2.H4(S241P), and the anti-PD-1 antibody is IBI308.

In some embodiments, the anti-TIGIT antibody is CPA.9.083.H4(S241P), the anti-PVRIG antibody is CHA.7.518.1.H4(S241P), and the anti-PD-1 antibody is IBI308.

In some embodiments, the anti-TIGIT antibody is CPA.9.086.H4(S241P), the anti-PVRIG antibody is CHA.7.538.1.2.H4(S241P), and the anti-PD-1 antibody is IBI308.

In some embodiments, the anti-TIGIT antibody is CPA.9.086.H4(S241P), the anti-PVRIG antibody is CHA.7.518.1.H4(S241P), and the anti-PD-1 antibody is IBI308.

In some embodiments, the anti-TIGIT antibody is CHA.9.547.7.H4(S241P), the anti-PVRIG antibody is CHA.7.538.1.2.H4(S241P), and the anti-PD-1 antibody is IBI308.

In some embodiments, the anti-TIGIT antibody is CHA.9.547.7.H4(S241P), the anti-PVRIG antibody is CHA.7.518.1.H4(S241P), and the anti-PD-1 antibody is IBI308.

In some embodiments, the anti-TIGIT antibody is CHA.9.547.13.H4(S241P), the anti-PVRIG antibody is CHA.7.538.1.2.H4(S241P), and the anti-PD-1 antibody is IBI308.

In some embodiments, the anti-TIGIT antibody is CHA.9.547.13.H4(S241P), the anti-PVRIG antibody is CHA.7.518.1.H4(S241P), and the anti-PD-1 antibody is IBI308.

In some embodiments, the anti-TIGIT antibody is CPA.9.083.H4(S241P), the anti-PVRIG antibody is CHA.7.538.1.2.H4(S241P), and the anti-PD-1 antibody is BGB-A317.

In some embodiments, the anti-TIGIT antibody is CPA.9.083.H4(S241P), the anti-PVRIG antibody is CHA.7.518.1.H4(S241P), and the anti-PD-1 antibody is BGB-A317.

In some embodiments, the anti-TIGIT antibody is CPA.9.086.H4(S241P), the anti-PVRIG antibody is CHA.7.538.1.2.H4(S241P), and the anti-PD-1 antibody is BGB-A317.

In some embodiments, the anti-TIGIT antibody is CPA.9.086.H4(S241P), the anti-PVRIG antibody is CHA.7.518.1.H4(S241P), and the anti-PD-1 antibody is BGB-A317.

In some embodiments, the anti-TIGIT antibody is CHA.9.547.7.H4(S241P), the anti-PVRIG antibody is CHA.7.538.1.2.H4(S241P), and the anti-PD-1 antibody is BGB-A317.

In some embodiments, the anti-TIGIT antibody is CHA.9.547.7.H4(S241P), the anti-PVRIG antibody is CHA.7.518.1.H4(S241P), and the anti-PD-1 antibody is BGB-A317.

In some embodiments, the anti-TIGIT antibody is CHA.9.547.13.H4(S241P), the anti-PVRIG antibody is CHA.7.538.1.2.H4(S241P), and the anti-PD-1 antibody is BGB-A317.

In some embodiments, the anti-TIGIT antibody is CHA.9.547.13.H4(S241P), the anti-PVRIG antibody is CHA.7.518.1.H4(S241P), and the anti-PD-1 antibody is BGB-A317.

In some embodiments, the anti-TIGIT antibody is CPA.9.083.H4(S241P), the anti-PVRIG antibody is CHA.7.538.1.2.H4(S241P), and the anti-PD-1 antibody is an anti-PD-1 antibody as recited in U.S. Patent Publication No. 2017/0081409.

In some embodiments, the anti-TIGIT antibody is CPA.9.083.H4(S241P), the anti-PVRIG antibody is CHA.7.518.1.H4(S241P), and the anti-PD-1 antibody is an anti-PD-1 antibody as recited in U.S. Patent Publication No. 2017/0081409.

In some embodiments, the anti-TIGIT antibody is CPA.9.086.H4(S241P), the anti-PVRIG antibody is CHA.7.538.1.2.H4(S241P), and the anti-PD-1 antibody is an anti-PD-1 antibody as recited in U.S. Patent Publication No. 2017/0081409.

In some embodiments, the anti-TIGIT antibody is CPA.9.086.H4(S241P), the anti-PVRIG antibody is CHA.7.518.1.H4(S241P), and the anti-PD-1 antibody is an anti-PD-1 antibody as recited in U.S. Patent Publication No. 2017/0081409.

In some embodiments, the anti-TIGIT antibody is CHA.9.547.7.H4(S241P), the anti-PVRIG antibody is CHA.7.538.1.2.H4(S241P), and the anti-PD-1 antibody is an anti-PD-1 antibody as recited in U.S. Patent Publication No. 2017/0081409.

In some embodiments, the anti-TIGIT antibody is CHA.9.547.7.H4(S241P), the anti-PVRIG antibody is CHA.7.518.1.H4(S241P), and the anti-PD-1 antibody is an anti-PD-1 antibody as recited in U.S. Patent Publication No. 2017/0081409.

In some embodiments, the anti-TIGIT antibody is CHA.9.547.13.H4(S241P), the anti-PVRIG antibody is CHA.7.538.1.2.H4(S241P), and the anti-PD-1 antibody is an anti-PD-1 antibody as recited in U.S. Patent Publication No. 2017/0081409.

In some embodiments, the anti-TIGIT antibody is CHA.9.547.13.H4(S241P), the anti-PVRIG antibody is CHA.7.518.1.H4(S241P), and the anti-PD-1 antibody is an anti-PD-1 antibody as recited in U.S. Patent Publication No. 2017/0081409.

In some embodiments, the anti-TIGIT antibody is CPA.9.083.H4(S241P), the anti-PVRIG antibody is CHA.7.538.1.2.H4(S241P), and the anti-PD-1 antibody is cemiplimab.

In some embodiments, the anti-TIGIT antibody is CPA.9.083.H4(S241P), the anti-PVRIG antibody is CHA.7.518.1.H4(S241P), and the anti-PD-1 antibody is cemiplimab.

In some embodiments, the anti-TIGIT antibody is CPA.9.086.H4(S241P), the anti-PVRIG antibody is CHA.7.538.1.2.H4(S241P), and the anti-PD-1 antibody is cemiplimab.

In some embodiments, the anti-TIGIT antibody is CPA.9.086.H4(S241P), the anti-PVRIG antibody is CHA.7.518.1.H4(S241P), and the anti-PD-1 antibody is cemiplimab.

In some embodiments, the anti-TIGIT antibody is CHA.9.547.7.H4(S241P), the anti-PVRIG antibody is CHA.7.538.1.2.H4(S241P), and the anti-PD-1 antibody is cemiplimab.

In some embodiments, the anti-TIGIT antibody is CHA.9.547.7.H4(S241P), the anti-PVRIG antibody is CHA.7.518.1.H4(S241P), and the anti-PD-1 antibody is cemiplimab.

In some embodiments, the anti-TIGIT antibody is CHA.9.547.13.H4(S241P), the anti-PVRIG antibody is CHA.7.538.1.2.H4(S241P), and the anti-PD-1 antibody is cemiplimab.

In some embodiments, the anti-TIGIT antibody is CHA.9.547.13.H4(S241P), the anti-PVRIG antibody is CHA.7.518.1.H4(S241P), and the anti-PD-1 antibody is cemiplimab.

In some embodiments, the anti-TIGIT antibody is CPA.9.083.H4(S241P), the anti-PD-L1 antibody is atezolizumab, and the anti-PVRIG antibody is one of the above and/or from FIG. 5 or 63.

In some embodiments, the anti-TIGIT antibody is CPA.9.086.H4(S241P the anti-PD-L1 antibody is atezolizumab, and the anti-PVRIG antibody is one of the above and/or from FIG. 5 or 63.

In some embodiments, the anti-TIGIT antibody is CHA.9.547.7.H4(S241P), the anti-PD-L1 antibody is atezolizumab, and the anti-PVRIG antibody is one of the above and/or from FIG. 5 or 63.

In some embodiments, the anti-TIGIT antibody is CHA.9.547.13.H4(S241P), the anti-PD-L1 antibody is atezolizumab, and the anti-PVRIG antibody is one of the above and/or from FIG. 5 or 63.

In some embodiments, the anti-TIGIT antibody is CPA.9.083.H4(S241P), the anti-PD-L1 antibody is avelumab, and the anti-PVRIG antibody is one of the above and/or from FIG. 5 or 63.

In some embodiments, the anti-TIGIT antibody is CPA.9.086.H4(S241P), the anti-PD-L1 antibody is avelumab, and the anti-PVRIG antibody is one of the above and/or from FIG. 5 or 63.

In some embodiments, the anti-TIGIT antibody is CHA.9.547.7.H4(S241P), the anti-PD-L1 antibody is avelumab, and the anti-PVRIG antibody is one of the above and/or from FIG. 5 or 63.

In some embodiments, the anti-TIGIT antibody is CHA.9.547.13.H4(S241P the anti-PD-L1 antibody is avelumab, and the anti-PVRIG antibody is one of the above and/or from FIG. 5 or 63.

In some embodiments, the anti-TIGIT antibody is CPA.9.083.H4(S241P), the anti-PD-L1 antibody is durvalumab, and the anti-PVRIG antibody is one of the above and/or from FIG. 5 or 63.

In some embodiments, the anti-TIGIT antibody is CPA.9.086.H4(S241P the anti-PD-L1 antibody is durvalumab, and the anti-PVRIG antibody is one of the above and/or from FIG. 5 or 63.

In some embodiments, the anti-TIGIT antibody is CHA.9.547.7.H4(S241P), the anti-PD-L1 antibody is durvalumab, and the anti-PVRIG antibody is one of the above and/or from FIG. 5 or 63.

In some embodiments, the anti-TIGIT antibody is CHA.9.547.13.H4(S241P), the anti-PD-L1 antibody is durvalumab, and the anti-PVRIG antibody is one of the above and/or from FIG. 5 or 63.

In some embodiments, the anti-PVRIG antibody is CHA.7.518.1.H4(S241P), the anti-PD-L1 antibody is atezolizumab, and the anti-TIGIT antibody one of the above and/or from FIG. 3.

In some embodiments, the anti-PVRIG antibody is CHA.7.538.1.2.H4(S241P), the anti-PD-L1 antibody is atezolizumab, and the anti-TIGIT antibody one of the above and/or from FIG. 3.

In some embodiments, the anti-PVRIG antibody is CHA.7.518.1.H4(S241P), the anti-PD-L1 antibody is atezolizumab, and the anti-TIGIT antibody one of the above and/or from FIG. 3.

In some embodiments, the anti-PVRIG antibody is CHA.7.538.1.2.H4(S241P), the anti-PD-L1 antibody is atezolizumab, and the anti-TIGIT antibody one of the above and/or from FIG. 3.

In some embodiments, the anti-PVRIG antibody is CHA.7.518.1.H4(S241P), the anti-PD-L1 antibody is avelumab, and the anti-TIGIT antibody one of the above and/or from FIG. 3.

In some embodiments, the anti-PVRIG antibody is CHA.7.538.1.2.H4(S241P), the anti-PD-L1 antibody is avelumab, and the anti-TIGIT antibody one of the above and/or from FIG. 3.

In some embodiments, the anti-PVRIG antibody is CHA.7.518.1.H4(S241P), the anti-PD-L1 antibody is avelumab, and the anti-TIGIT antibody one of the above and/or from FIG. 3.

In some embodiments, the anti-PVRIG antibody is CHA.7.538.1.2.H4(S241P), the anti-PD-L1 antibody is avelumab, and the anti-TIGIT antibody one of the above and/or from FIG. 3.

In some embodiments, the anti-PVRIG antibody is CHA.7.518.1.H4(S241P), the anti-PD-L1 antibody is durvalumab, and the anti-TIGIT antibody one of the above and/or from FIG. 3.

In some embodiments, the anti-PVRIG antibody is CHA.7.538.1.2.H4(S241P), the anti-PD-L1 antibody is durvalumab, and the anti-TIGIT antibody one of the above and/or from FIG. 3.

In some embodiments, the anti-PVRIG antibody is CHA.7.518.1.H4(S241P), the anti-PD-L1 antibody is durvalumab, and the anti-TIGIT antibody one of the above and/or from FIG. 3.

In some embodiments, the anti-PVRIG antibody is CHA.7.538.1.2.H4(S241P), the anti-PD-L1 antibody is durvalumab, and the anti-TIGIT antibody one of the above and/or from FIG. 3.

In some embodiments, the anti-TIGIT antibody is CPA.9.083.H4(S241P), the anti-PVRIG antibody is CHA.7.538.1.2.H4(S241P), and the anti-PD-L1 antibody is atezolizumab.

In some embodiments, the anti-TIGIT antibody is CPA.9.083.H4(S241P), the anti-PVRIG antibody is CHA.7.518.1.H4(S241P), and the anti-PD-L1 antibody is atezolizumab.

In some embodiments, the anti-TIGIT antibody is CPA.9.086.H4(S241P), the anti-PVRIG antibody is CHA.7.538.1.2.H4(S241P), and the anti-PD-L1 antibody is atezolizumab.

In some embodiments, the anti-TIGIT antibody is CPA.9.086.H4(S241P), the anti-PVRIG antibody is CHA.7.518.1.H4(S241P), and the anti-PD-L1 antibody is atezolizumab.

In some embodiments, the anti-TIGIT antibody is CHA.9.547.7.H4(S241P), the anti-PVRIG antibody is CHA.7.538.1.2.H4(S241P), and the anti-PD-L1 antibody is atezolizumab.

In some embodiments, the anti-TIGIT antibody is CHA.9.547.7.H4(S241P), the anti-PVRIG antibody is CHA.7.518.1.H4(S241P), and the anti-PD-L1 antibody is atezolizumab.

In some embodiments, the anti-TIGIT antibody is CHA.9.547.13.H4(S241P), the anti-PVRIG antibody is CHA.7.538.1.2.H4(S241P), and the anti-PD-L1 antibody is atezolizumab.

In some embodiments, the anti-TIGIT antibody is CHA.9.547.13.H4(S241P), the anti-PVRIG antibody is CHA.7.518.1.H4(S241P), and the anti-PD-L1 antibody is atezolizumab.

In some embodiments, the anti-TIGIT antibody is CPA.9.083.H4(S241P), the anti-PVRIG antibody is CHA.7.538.1.2.H4(S241P), and the anti-PD-L1 antibody is avelumab.

In some embodiments, the anti-TIGIT antibody is CPA.9.083.H4(S241P), the anti-PVRIG antibody is CHA.7.518.1.H4(S241P), and the anti-PD-L1 antibody is avelumab.

In some embodiments, the anti-TIGIT antibody is CPA.9.086.H4(S241P), the anti-PVRIG antibody is CHA.7.538.1.2.H4(S241P), and the anti-PD-L1 antibody is avelumab.

In some embodiments, the anti-TIGIT antibody is CPA.9.086.H4(S241P), the anti-PVRIG antibody is CHA.7.518.1.H4(S241P), and the anti-PD-L1 antibody is avelumab.

In some embodiments, the anti-TIGIT antibody is CHA.9.547.7.H4(S241P), the anti-PVRIG antibody is CHA.7.538.1.2.H4(S241P), and the anti-PD-L1 antibody is avelumab.

In some embodiments, the anti-TIGIT antibody is CHA.9.547.7.H4(S241P), the anti-PVRIG antibody is CHA.7.518.1.H4(S241P), and the anti-PD-L1 antibody is avelumab.

In some embodiments, the anti-TIGIT antibody is CHA.9.547.13.H4(S241P), the anti-PVRIG antibody is CHA.7.538.1.2.H4(S241P), and the anti-PD-L1 antibody is avelumab.

In some embodiments, the anti-TIGIT antibody is CHA.9.547.13.H4(S241P), the anti-PVRIG antibody is CHA.7.518.1.H4(S241P), and the anti-PD-L1 antibody is avelumab.

In some embodiments, the anti-TIGIT antibody is CPA.9.083.H4(S241P), the anti-PVRIG antibody is CHA.7.538.1.2.H4(S241P), and the anti-PD-L1 antibody is durvalumab.

In some embodiments, the anti-TIGIT antibody is CPA.9.083.H4(S241P), the anti-PVRIG antibody is CHA.7.518.1.H4(S241P), and the anti-PD-L1 antibody is durvalumab.

In some embodiments, the anti-TIGIT antibody is CPA.9.086.H4(S241P), the anti-PVRIG antibody is CHA.7.538.1.2.H4(S241P), and the anti-PD-L1 antibody is durvalumab.

In some embodiments, the anti-TIGIT antibody is CPA.9.086.H4(S241P), the anti-PVRIG antibody is CHA.7.518.1.H4(S241P), and the anti-PD-L1 antibody is durvalumab.

In some embodiments, the anti-TIGIT antibody is CHA.9.547.7.H4(S241P), the anti-PVRIG antibody is CHA.7.538.1.2.H4(S241P), and the anti-PD-L1 antibody is durvalumab.

In some embodiments, the anti-TIGIT antibody is CHA.9.547.7.H4(S241P), the anti-PVRIG antibody is CHA.7.518.1.H4(S241P), and the anti-PD-L1 antibody is durvalumab.

In some embodiments, the anti-TIGIT antibody is CHA.9.547.13.H4(S241P), the anti-PVRIG antibody is CHA.7.538.1.2.H4(S241P), and the anti-PD-L1 antibody is durvalumab.

In some embodiments, the anti-TIGIT antibody is CHA.9.547.13.H4(S241P), the anti-PVRIG antibody is CHA.7.518.1.H4(S241P), and the anti-PD-L1 antibody is durvalumab.

B. Biomarker Analysis

As shown herein, the selection of the combination therapy to administer can be done using an evaluation of the expression of particular biomarkers from tumor biopsy.

That is, by taking a biopsy from a tumor sample of a patient and testing for the presence and levels of certain proteins using protein staining and sorting, a suitable therapy can be chosen. As shown in Example 2, cells from tumors can be screened to identify immune and non-immune cell populations, and then the immune cell populations assessed for the levels of a number of biomarkers including PD-1, PD-L1, PVRIG, PVR, PVRL2 and TIGIT, including by examining both ligand and antigen levels.

Thus, for example, to identify immune cell populations, antibodies to one or more of CD45, CD3, CD8, CD33, CD25, CD127, CD14, CD4 and CD56 can be assessed to categorize the cell populations in the tumor sample as shown below in Table 1:

| Cell Subset Name | Gating Markers |
|---|---|
| CD4$^+$ T cells | CD45$^+$CD3$^+$CD14$^-$CD4$^+$ |
| CD8$^+$ T cells | CD45$^+$CD3$^+$CD14$^-$CD8$^+$ |
| CD4$^-$CD8$^-$ T cells | CD45$^+$CD3$^+$CD14$^-$CD4$^-$CD8$^-$ |
| NK cells | CD45$^+$CD3$^-$CD14$^-$CD56$^+$ |
| Monocytes | CD45$^+$CD3$^-$CD14$^+$ |
| mDCs | CD45$^+$CD3$^-$CD14$^-$CD56$^-$CD33$^{hi}$ |
| pDCs | CD45$^+$CD3$^-$CD14$^-$CD56$^-$CD33$^{mid}$ |
| CD45$^-$ cells | CD45$^-$ |

Several of these cell types are then assessed for expression of one or more of PD-1, PD-L1, PVRIG, PVR, PVRL2 and TIGIT, generally using labeled antibodies and scored. If the percentage of PD-L1 positive tumor cells or immune cells is greater than 1% (>1%) compared to the same tumor cells stained with antibody relevant isotype control antibody for the antibodies used, then a triple combination of anti-TIGIT, anti-PVRIG and anti-PD1 antibodies should be administered. Whereas, patients with a frequency of PD-L1 positive tumor cells or immune cells below 1% (<1%) compared to the isotype control should be administered a double combination of anti-TIGIT and anti-PVRIG antibodies. 1. Combination Therapy of Anti-TIGIT, Anti-PVRIG and Anti-PD-1 Antibodies In some embodiments, once the immune cells from the tumor have been optionally tested for expression of at least one cell surface marker selected from PD-1, PD-L1, PVRIG, PVR, PVRL2 and TIGIT, therapeutic decisions can be made. In the case where the expression of PD-L1 positive tumor cells or immune cells is >1%, the patient can be administered a triple combination of anti-TIGIT, anti-PVRIG and anti-PD-1 antibodies as outlined herein.

Accordingly, in one embodiment, antibodies containing the CDR sets from the anti-TIGIT antibody CPA.9.083 are combined with antibodies containing the CDR sets from the anti-PVRIG antibody CHA.7.518.1 and pembrolizumab. In a particular embodiment, CPA.9.083.H4(S241P) is combined with CHA.7.518.1.H4(S241P) and pembrolizumab.

In one embodiment, antibodies containing the CDR sets from the anti-TIGIT antibody CPA.9.083 are combined with antibodies containing the CDR sets from the anti-PVRIG antibody CHA.7.538.1.2 and pembrolizumab. In a particular embodiment, CPA.9.083.H4(S241P) is combined with CHA.7.538.1.2.H4(S241P) and pembrolizumab.

In one embodiment, antibodies containing the CDR sets from the anti-TIGIT antibody CPA.9.086 are combined with antibodies containing the CDR sets from the anti-PVRIG antibody CHA.7.518.1 and pembrolizumab. In a particular embodiment, CPA.9.086.H4(S241P) is combined with CHA.7.518.1.H4(S241P) and pembrolizumab.

In one embodiment, antibodies containing the CDR sets from the anti-TIGIT antibody CPA.9.086 are combined with antibodies containing the CDR sets from the anti-PVRIG antibody CHA.7.538.1.2 and pembrolizumab. In a particular embodiment, CPA.9.086.H4(S241P) is combined with CHA.7.538.1.2.H4(S241P) and pembrolizumab.

In one embodiment, antibodies containing the CDR sets from the anti-TIGIT antibody CHA.9.547.7 are combined with antibodies containing the CDR sets from the anti-PVRIG antibody CHA.7.518.1 and pembrolizumab. In a particular embodiment, CHA.9.547.7H4(S241P) is combined with CHA.7.518.1.H4(S241P) and pembrolizumab.

In one embodiment, antibodies containing the CDR sets from the anti-TIGIT antibody CHA.9.547.7 are combined with antibodies containing the CDR sets from the anti-PVRIG antibody CHA.7.538.1.2 and pembrolizumab. In a particular embodiment, CHA.9.547.7.H4(S241P) is combined with CHA.7.538.1.2.H4(S241P) and pembrolizumab.

In one embodiment, antibodies containing the CDR sets from the anti-TIGIT antibody CHA.9.547.13 are combined with antibodies containing the CDR sets from the anti-PVRIG antibody CHA.7.518.1 and pembrolizumab. In a particular embodiment, CHA.9.547.13.H4(S241P) is combined with CHA.7.518.1.H4(S241P) and pembrolizumab.

In one embodiment, antibodies containing the CDR sets from the anti-TIGIT antibody CHA.9.547.13 are combined with antibodies containing the CDR sets from the anti-PVRIG antibody CHA.7.538.1.2 and pembrolizumab. In a particular embodiment, CHA.9.547.13.H4(S241P) is combined with CHA.7.538.1.2.H4(S241P) and pembrolizumab.

Accordingly, in one embodiment, antibodies containing the CDR sets from the anti-TIGIT antibody CPA.9.083 are combined with antibodies containing the CDR sets from the anti-PVRIG antibody CHA.7.518.1 and nivolumab. In a particular embodiment, CPA.9.083.H4(S241P) is combined with CHA.7.518.1.H4(S241P) and nivolumab.

In one embodiment, antibodies containing the CDR sets from the anti-TIGIT antibody CPA.9.083 are combined with antibodies containing the CDR sets from the anti-PVRIG antibody CHA.7.538.1.2 and nivolumab. In a particular embodiment, CPA.9.083.H4(S241P) is combined with CHA.7.538.1.2.H4(S241P) and nivolumab.

In one embodiment, antibodies containing the CDR sets from the anti-TIGIT antibody CPA.9.086 are combined with antibodies containing the CDR sets from the anti-PVRIG antibody CHA.7.518.1 and nivolumab. In a particular embodiment, CPA.9.086.H4(S241P) is combined with CHA.7.518.1.H4(S241P) and nivolumab.

In one embodiment, antibodies containing the CDR sets from the anti-TIGIT antibody CPA.9.086 are combined with antibodies containing the CDR sets from the anti-PVRIG antibody CHA.7.538.1.2 and nivolumab. In a particular embodiment, CPA.9.086.H4(S241P) is combined with CHA.7.538.1.2.H4(S241P) and nivolumab.

In one embodiment, antibodies containing the CDR sets from the anti-TIGIT antibody CHA.9.547.7 are combined with antibodies containing the CDR sets from the anti-PVRIG antibody CHA.7.518.1 and nivolumab. In a particular embodiment, CHA.9.547.7H4(S241P) is combined with CHA.7.518.1.H4(S241P) and nivolumab.

In one embodiment, antibodies containing the CDR sets from the anti-TIGIT antibody CHA.9.547.7 are combined with antibodies containing the CDR sets from the anti-PVRIG antibody CHA.7.538.1.2 and nivolumab. In a particular embodiment, CHA.9.547.7.H4(S241P) is combined with CHA.7.538.1.2.H4(S241P) and nivolumab.

In one embodiment, antibodies containing the CDR sets from the anti-TIGIT antibody CHA.9.547.13 are combined with antibodies containing the CDR sets from the anti-PVRIG antibody CHA.7.518.1 and nivolumab. In a particular embodiment, CHA.9.547.13.H4(S241P) is combined with CHA.7.518.1.H4(S241P) and nivolumab.

In one embodiment, antibodies containing the CDR sets from the anti-TIGIT antibody CHA.9.547.13 are combined with antibodies containing the CDR sets from the anti-PVRIG antibody CHA.7.538.1.2 and nivolumab. In a particular embodiment, CHA.9.547.13.H4(S241P) is combined with CHA.7.538.1.2.H4(S241P) and nivolumab.

Accordingly, in one embodiment, antibodies containing the CDR sets from the anti-TIGIT antibody CPA.9.083 are combined with antibodies containing the CDR sets from the anti-PVRIG antibody CHA.7.518.1 and cemiplimab. In a particular embodiment, CPA.9.083.H4(S241P) is combined with CHA.7.518.1.H4(S241P) and cemiplimab.

In one embodiment, antibodies containing the CDR sets from the anti-TIGIT antibody CPA.9.083 are combined with antibodies containing the CDR sets from the anti-PVRIG antibody CHA.7.538.1.2 and cemiplimab. In a particular embodiment, CPA.9.083.H4(S241P) is combined with CHA.7.538.1.2.H4(S241P) and cemiplimab.

In one embodiment, antibodies containing the CDR sets from the anti-TIGIT antibody CPA.9.086 are combined with antibodies containing the CDR sets from the anti-PVRIG antibody CHA.7.518.1 and cemiplimab. In a particular embodiment, CPA.9.086.H4(S241P is combined with CHA.7.518.1.H4(S241P) and cemiplimab.

In one embodiment, antibodies containing the CDR sets from the anti-TIGIT antibody CPA.9.086 are combined with antibodies containing the CDR sets from the anti-PVRIG antibody CHA.7.538.1.2 and cemiplimab. In a particular embodiment, CPA.9.086.H4(S241P) is combined with CHA.7.538.1.2.H4(S241P) and cemiplimab.

In one embodiment, antibodies containing the CDR sets from the anti-TIGIT antibody CHA.9.547.7 are combined with antibodies containing the CDR sets from the anti-PVRIG antibody CHA.7.518.1 and cemiplimab. In a particular embodiment, CHA.9.547.7H4(S241P) is combined with CHA.7.518.1.H4(S241P) and cemiplimab.

In one embodiment, antibodies containing the CDR sets from the anti-TIGIT antibody CHA.9.547.7 are combined with antibodies containing the CDR sets from the anti-PVRIG antibody CHA.7.538.1.2 and cemiplimab. In a particular embodiment, CHA.9.547.7.H4(S241P) is combined with CHA.7.538.1.2.H4(S241P) and cemiplimab.

In one embodiment, antibodies containing the CDR sets from the anti-TIGIT antibody CHA.9.547.13 are combined with antibodies containing the CDR sets from the anti-PVRIG antibody CHA.7.518.1 and cemiplimab. In a particular embodiment, CHA.9.547.13.H4(S241P) is combined with CHA.7.518.1.H4(S241P) and cemiplimab.

In one embodiment, antibodies containing the CDR sets from the anti-TIGIT antibody CHA.9.547.13 are combined with antibodies containing the CDR sets from the anti-PVRIG antibody CHA.7.538.1.2 and cemiplimab. In a particular embodiment, CHA.9.547.13.H4(S241P) is combined with CHA.7.538.1.2.H4(S241P) and cemiplimab.

2. Combination Therapy of Anti-TIGIT and Anti-PVRIG Antibodies

Similarly, once the once the immune cells from the tumor have been tested for expression of at least one cell surface marker selected from PD-1, PD-L1, PVRIG, PVR, PVRL2 and TIGIT, therapeutic decisions can be made. In the case where the expression of PD-L1 positive tumor cells or immune cells is <1%, the patient can be administered a double combination of anti-TIGIT and anti-PVRIG antibodies as outlined herein.

Accordingly, in one embodiment, antibodies containing the CDR sets from the anti-TIGIT antibody CPA.9.083 are combined with antibodies containing the CDR sets from the anti-PVRIG antibody CHA.7.518.1. In a particular embodiment, CPA.9.083.H4(S241P) is combined with CHA.7.518.1.H4(S241P).

In one embodiment, antibodies containing the CDR sets from the anti-TIGIT antibody CPA.9.083 are combined with antibodies containing the CDR sets from the anti-PVRIG antibody CHA.7.538.1.2. In a particular embodiment, CPA.9.083.H4(S241P) is combined with CHA.7.538.1.2.H4 (S241P).

In one embodiment, antibodies containing the CDR sets from the anti-TIGIT antibody CPA.9.086 are combined with antibodies containing the CDR sets from the anti-PVRIG antibody CHA.7.518.1. In a particular embodiment, CPA.9.086.H4(S241P) is combined with CHA.7.518.1.H4 (S241P).

In one embodiment, antibodies containing the CDR sets from the anti-TIGIT antibody CPA.9.086 are combined with antibodies containing the CDR sets from the anti-PVRIG antibody CHA.7.538.1.2. In a particular embodiment, CPA.9.086.H4(S241P) is combined with CHA.7.538.1.2.H4 (S241P).

In one embodiment, antibodies containing the CDR sets from the anti-TIGIT antibody CHA.9.547.7 are combined with antibodies containing the CDR sets from the anti-PVRIG antibody CHA.7.518.1. In a particular embodiment, CHA.9.547.7H4(S241P) is combined with CHA.7.518.1.H4 (S241P).

In one embodiment, antibodies containing the CDR sets from the anti-TIGIT antibody CHA.9.547.7 are combined with antibodies containing the CDR sets from the anti-PVRIG antibody CHA.7.538.1.2. In a particular embodiment, CHA.9.547.7.H4(S241P) is combined with CHA.7.538.1.2.H4(S241P).

In one embodiment, antibodies containing the CDR sets from the anti-TIGIT antibody CHA.9.547.13 are combined with antibodies containing the CDR sets from the anti-PVRIG antibody CHA.7.518.1. In a particular embodiment, CHA.9.547.13.H4(S241P) is combined with CHA.7.518.1.H4(S241P).

In one embodiment, antibodies containing the CDR sets from the anti-TIGIT antibody CHA.9.547.13 are combined with antibodies containing the CDR sets from the anti-PVRIG antibody CHA.7.538.1.2. In a particular embodiment, CHA.9.547.13.H4(S241P) is combined with CHA.7.538.1.2.H4(S241P).

In one embodiment, the invention provides combinations of the anti-TIGIT antibodies of the invention and anti-PD-1 antibodies. In one embodiment, the invention provides combinations of the anti-TIGIT antibodies of the invention and anti-PD-L1 antibodies.

In one embodiment, a biopsy is taken from a tumor from a patient with cancer, and dissociated as is known in the art for FACS analysis. The cells are stained with labeled antibodies to (1) TIGIT (for example using any described herein or others in the art such as MBSA43); (2) PD-1 (for example using those known in the art including EH12.2H7, Keytruda®, Opdivo®, Cemiplimab, etc.); (3) PD-L1 (for example using those known in the art such as BM-1, atezolizumab, avelumab, and durvalumab, outlined herein) and (4) PVR (for example using those known in the art such as SKII.4); and (5) a relevant isotype control antibody for the antibodies used. FACS is done, and for each receptor, the percentage of the cells expressing the receptor relative to the control antibody is calculated. If the percentage of positive cells for TIGIT, PD-1, PD-1 and PVR is ≥1% for all 4 receptors, then the patient is treated with antibodies to TIGIT and PD-1 as outlined herein.

In one embodiment, a biopsy is taken from a tumor from a patient with cancer, and dissociated as is known in the art for FACS analysis. The cells are stained with labeled antibodies to (1) PVRIG (generally using CHA.7.518.1H4 (S241P), for example, although any outlined in WO2016/134333 (specifically including any that bind, even if they don't block) or WO2017/041004) can be used); (2) PD-1 (for example using those known in the art including EH12.2H7, Keytruda®, Opdivo®, Cemiplimab, etc.); (3) PD-L1 (for example using those known in the art such as BM-1, atezolizumab, avelumab, and durvalumab, outlined herein) and (4) PVRL2 (for example using those known in the art such as TX11); and (5) a relevant isotype control antibody for the antibodies used. FACS is done, and for each receptor, the percentage of the cells expressing the receptor relative to the control antibody is calculated. If the percentage of positive cells for PVRIG, PD-1, PD-1 and PVRL2 is ≥1% for all 4 receptors, then the patient is treated with antibodies to PVRIG and PD-1 as outlined herein.

In one embodiment, a biopsy is taken from a tumor from a patient with cancer, and dissociated as is known in the art for FACS analysis. The cells are stained with labeled antibodies to (1) PVRIG (generally using CHA.7.518.1H4 (S241P), for example, although any outlined in WO2016/134333 (specifically including any that bind, even if they don't block) or WO2017/041004) can be used); (2) TIGIT (for example using any described herein or others in the art such as MBSA43); (3) PVR (for example using those known in the art such as SKII.4) and (4) PVRL2 (for example using those known in the art such as TX11); and (5) a relevant isotype control antibody for the antibodies used. FACS is done, and for each receptor, the percentage of the cells expressing the receptor relative to the control antibody is calculated. If the percentage of positive cells for PVRIG, TIGIT, PVR and PVRL2 is ≥1% for all 4 receptors, then the patient is treated with antibodies to PVRIG and TIGIT. Preferred combinations in this regard are CHA.7.518.1.H4 (S241P) and CPA.9.086.

In one embodiment, a biopsy is taken from a tumor from a patient with cancer, and dissociated as is known in the art for FACS analysis. The cells are stained with labeled antibodies to (1) PVRIG (generally using CHA.7.518.1H4 (S241P), for example, although any outlined in WO2016/134333 (specifically including any that bind, even if they don't block) or WO2017/041004) can be used); (2) TIGIT (for example using any described herein or others in the art such as MBSA43); (3) PVR (for example using those known in the art such as SKII.4) and (4) PVRL2 (for example using those known in the art such as TX11); (5) PD-1 (for example using those known in the art including EH12.2H7, Keytruda®, Opdivo®, Cemiplimab, etc.); and (6) a relevant isotype control antibody for the antibodies used. FACS is done, and for each receptor, the percentage of the cells expressing the receptor relative to the control antibody is calculated. If the percentage of positive cells for PVRIG, TIGIT, PVR, PVRL2 and PD-1 is ≥1% for all 5 receptors, then the patient is treated with antibodies to PVRIG, TIGIT, and PD-1. Preferred combinations in this regard are CHA.7.518.1.H4(S241P), CPA.9.086, and EH12.2H7. Other preferred combinations in this regard are CHA.7.518.1.H4(S241P), CPA.9.086, and Keytruda®. Yet other preferred combinations in this regard are CHA.7.518.1.H4(S241P), CPA.9.086, and Opdivo®.

In one embodiment, a biopsy is taken from a tumor from a patient with cancer, and dissociated as is known in the art for FACS analysis. The cells are stained with labeled antibodies to (1) PVRIG (generally using CHA.7.518.1H4 (S241P), for example, although any outlined in WO2016/134333 (specifically including any that bind, even if they don't block) or WO2017/041004) can be used); (2) TIGIT (for example using any described herein or others in the art such as MBSA43); ((3) PD-L1 (for example using those known in the art such as BM-1, atezolizumab, avelumab, and durvalumab, outlined herein) and (4) PVR (for example using those known in the art such as SKII.4); (5) PD-1 (for example using those known in the art including EH12.2H7, Keytruda®, Opdivo®, Cemiplimab, etc.); and (6) a relevant isotype control antibody for the antibodies used. FACS is done, and for each receptor, the percentage of the cells expressing the receptor relative to the control antibody is calculated. If the percentage of positive cells for PVRIG, TIGIT, PD-L1, PVR and PD-1 is ≥1% for all 5 receptors, then the patient is treated with antibodies to PVRIG, TIGIT, and PD-1. Preferred combinations in this regard are CHA.7.518.1.H4(S241P), CPA.9.086, and EH12.2H7. Other preferred combinations in this regard are CHA.7.518.1.H4(S241P), CPA.9.086, and Keytruda®. Yet other preferred combinations in this regard are CHA.7.518.1.H4(S241P), CPA.9.086, and Opdivo®.

3. Combination Therapy of Anti-TIGIT and Anti-PVRIG Antibodies with PD-1 Antibodies for Refractory Patients In some embodiments, the treatment includes a combination of anti-TIGIT antibodies, anti-PVRIG antibodies, and anti-PD-1 antibodies for targeting tumor cells with high PD-L1 expression. In some embodiments, the treatment includes a combination of anti-TIGIT antibodies, anti-PVRIG antibodies, and anti-PD-1 antibodies for use in a patient whose tumors express PD-L1. In some embodiments, the treatment includes a combination of anti-TIGIT antibodies, anti-PVRIG antibodies, and anti-PD-1 antibodies for use in a cancer patient whose tumor expresses PD-L1 and/or who is refractory to anti-PD-1 therapeutics. In some embodiments, the treatment includes a combination of anti-TIGIT antibodies, anti-PVRIG antibodies, and anti-PD-1 antibodies for use in a cancer patient whose tumor expresses PD-L1 and who is refractory to anti-PD-1 therapeutics.

Accordingly, in one embodiment, antibodies containing the CDR sets from the anti-TIGIT antibody CPA.9.083 are combined with antibodies containing the CDR sets from the anti-PVRIG antibody CHA.7.518.1 and pembrolizumab for use in a cancer patient whose tumor expresses PD-L1 and/or who is refractory to anti-PD-1 therapeutics. In a particular embodiment, CPA.9.083.H4(S241P) is combined with CHA.7.518.1.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CPA.9.083 are combined with antibodies containing the CDR sets from the anti-PVRIG antibody CHA.7.538.1.2 and pembrolizuma for use in a cancer patient whose tumor expresses PD-L1 and/or who is refractory to anti-PD-1 therapeutics b. In a particular embodiment, CPA.9.083.H4(S241P) is combined with CHA.7.538.1.2.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CPA.9.086 are combined with antibodies containing the CDR sets from the anti-PVRIG antibody CHA.7.518.1 and pembrolizumab for use in a cancer patient whose tumor expresses PD-L1 and/or who is refractory to anti-PD-1 therapeutics. In a particular embodiment, CPA.9.086.H4(S241P is combined with CHA.7.518.1.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CPA.9.086 are combined with antibodies containing the CDR sets from the anti-PVRIG antibody CHA.7.538.1.2 and pembrolizumab for use in a cancer patient whose tumor expresses PD-L1 and/or who is refractory to anti-PD-1 therapeutics. In a particular embodiment, CPA.9.086.H4(S241P) is combined with CHA.7.538.1.2.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CHA.9.547.7 are combined with antibodies containing the CDR sets from the anti-PVRIG antibody CHA.7.518.1 and pembrolizumab for use in a cancer patient whose tumor expresses PD-L1 and/or who is refractory to anti-PD-1 therapeutics. In a particular embodiment, CHA.9.547.7H4(S241P) is combined with CHA.7.518.1.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CHA.9.547.7 are combined with antibodies containing the CDR sets from the anti-PVRIG antibody CHA.7.538.1.2 and pembrolizumab for use in a cancer patient whose tumor expresses PD-L1 and/or who is refractory to anti-PD-1 therapeutics. In a particular embodiment, CHA.9.547.7.H4(S241P) is combined with CHA.7.538.1.2.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CHA.9.547.13 are combined with antibodies containing the CDR sets from the anti-PVRIG antibody CHA.7.518.1 and pembrolizumab for use in a cancer patient whose tumor expresses PD-L1 and/or who is refractory to anti-PD-1 therapeutics. In a particular embodiment, CHA.9.547.13.H4(S241P) is combined with CHA.7.518.1.H4(S241P) and pembrolizumab for use in a cancer patient whose tumor expresses PD-L1 and/or who is refractory to anti-PD-1 therapeutics.

In one embodiment, antibodies containing the CDR sets from the anti-TIGIT antibody CHA.9.547.13 are combined with antibodies containing the CDR sets from the anti-PVRIG antibody CHA.7.538.1.2 and pembrolizumab for use in a cancer patient whose tumor expresses PD-L1 and/or who is refractory to anti-PD-1 therapeutics. In a particular embodiment, CHA.9.547.13.H4(S241P) is combined with CHA.7.538.1.2.H4(S241P) and pembrolizumab for use in a cancer patient whose tumor expresses PD-L1 and/or who is refractory to anti-PD-1 therapeutics.

Accordingly, in one embodiment, antibodies containing the CDR sets from the anti-TIGIT antibody CPA.9.083 are combined with antibodies containing the CDR sets from the anti-PVRIG antibody CHA.7.518.1 and nivolumab for use in a cancer patient whose tumor expresses PD-L1 and/or who is refractory to anti-PD-1 therapeutics. In a particular embodiment, CPA.9.083.H4(S241P) is combined with CHA.7.518.1.H4(S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CPA.9.083 are combined with antibodies containing the CDR sets from the anti-PVRIG antibody CHA.7.538.1.2 and nivolumab for use in a cancer patient whose tumor expresses PD-L1 and/or who is refractory to anti-PD-1 therapeutics. In a particular embodiment, CPA.9.083.H4(S241P) is combined with CHA.7.538.1.2.H4 (S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CPA.9.086 are combined with antibodies containing the CDR sets from the anti-PVRIG antibody CHA.7.518.1 and nivolumab for use in a cancer patient whose tumor expresses PD-L1 and/or who is refractory to anti-PD-1 therapeutics. In a particular embodiment, CPA.9.086.H4(S241P is combined with CHA.7.518.1.H4(S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CPA.9.086 are combined with antibodies containing the CDR sets from the anti-PVRIG antibody CHA.7.538.1.2 and nivolumab for use in a cancer patient whose tumor expresses PD-L1 and/or who is refractory to anti-PD-1 therapeutics. In a particular embodiment, CPA.9.086.H4(S241P) is combined with CHA.7.538.1.2.H4(S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CHA.9.547.7 are combined with antibodies containing the CDR sets from the anti-PVRIG antibody CHA.7.518.1 and nivolumab for use in a cancer patient whose tumor expresses PD-L1 and/or who is refractory to anti-PD-1 therapeutics. In a particular embodiment, CHA.9.547.7H4(S241P) is combined with CHA.7.518.1.H4(S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CHA.9.547.7 are combined with antibodies containing the CDR sets from the anti-PVRIG antibody CHA.7.538.1.2 and nivolumab for use in a cancer patient whose tumor expresses PD-L1 and/or who is refractory to anti-PD-1 therapeutics. In a particular embodiment, CHA.9.547.7.H4(S241P) is combined with CHA.7.538.1.2.H4(S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CHA.9.547.13 are combined with antibodies containing the CDR sets from the anti-PVRIG antibody CHA.7.518.1 and nivolumab for use in a cancer patient whose tumor expresses PD-L1 and/or who is refractory to anti-PD-1 therapeutics. In a particular embodiment, CHA.9.547.13.H4(S241P) is combined with CHA.7.518.1.H4(S241P) and nivolumab for use in a cancer patient whose tumor expresses PD-L1 and/or who is refractory to anti-PD-1 therapeutics.

In one embodiment, antibodies containing the CDR sets from the anti-TIGIT antibody CHA.9.547.13 are combined with antibodies containing the CDR sets from the anti-PVRIG antibody CHA.7.538.1.2 and nivolumab for use in a cancer patient whose tumor expresses PD-L1 and/or who is refractory to anti-PD-1 therapeutics. In a particular embodiment, CHA.9.547.13.H4(S241P) is combined with CHA.7.538.1.2.H4(S241P) and nivolumab for use in a cancer patient whose tumor expresses PD-L1 and/or who is refractory to anti-PD-1 therapeutics.

In some embodiments, the anti-TIGIT antibody is an antibody chosen from any anti-TIGIT antibody described herein, including any of those described in FIG. 3. In some embodiments, the anti-PVRIG antibody is an antibody chosen from any anti-PVRIG antibody described herein, including any of those described in FIG. 5 and/or FIG. 63. In some embodiments, the anti-PD-1 antibody is an antibody chosen from any anti-PD-1 antibody described herein, including any of those described in FIG. 7.

4. Assessment of Treatment

Generally, the antibodies of the invention, alone or in combination (PVRIG with PD-1, TIGIT with PD-1 or TIGIT with PVRIG, and/or PVRIG with both TIGIT and PD-1) are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g. presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on $CD4^+$ T cell activation or proliferation, $CD8^+$ T (CTL) cell activation or proliferation, $CD8^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-$\gamma$ or TNF-$\alpha$ production by T or other immune cells.

In some embodiments, assessment of treatment is done by evaluating immune cell proliferation, using for example, CFSE dilution method, Ki67 intracellular staining of immune effector cells, and 3H-Thymidine incorporation method.

In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In some embodiments, the assessment of treatment is done by assessing the amount of T cell proliferation in the absence of treatment, for example prior to administration of the antibodies of the invention. If, after administration, the patient has an increase in T cell proliferation, e.g. a subset of the patient's T cells are proliferating, this is an indication that the T cells were activated.

Similarly, assessment of treatment with the antibodies of the invention can be done by measuring the patient's IFN-$\gamma$ levels prior to administration and post-administration to assess efficacy of treatment. This may be done within hours or days.

In general, gene expression assays are done as is known in the art. See for example Goodkind et al., Computers and Chem. Eng. 29(3):589 (2005), Han et al., Bioinform. Biol. Insights 11/15/15 9(Suppl. 1):29-46, Campo et al., Nod. Pathol. 2013 January; 26 suppl. 1:S97-S110, the gene expression measurement techniques of which are expressly incorporated by reference herein.

In general, protein expression measurements are also similarly done as is known in the art, see for example, Wang et al., Recent Advances in Capillary Electrophoresis-Based Proteomic Techniques for Biomarker Discovery, Methods. Mol. Biol. 2013:984:1-12; Taylor et al, BioMed Res. Volume 2014, Article ID 361590, 8 pages, Becerk et al., Mutat.

Res 2011 Jun. 17:722(2): 171-182, the measurement techniques of which are expressly incorporated herein by reference.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFN-γ, TNF-α, GM-CSF, IL-2, IL-6, IL-4, IL-5, IL-10, and/or IL-13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

Assays to Measure Efficacy

In some embodiments, T cell activation is assessed using a Mixed Lymphocyte Reaction (MLR) assay as is described in the Examples. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-α, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of at least about 5%, 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Specific increases in activity are depicted in the attached figures. For example, with regard to increases in T cell proliferation, CHA.7.518.1.H4(S241P) shows an increase of about 60% and CHA.7.538.1.2.H4(S241P) shows an increase of 47%; relevant increases are shown in either T cell proliferation or IFN-γ of from about 10 to 70% with from about 20 to 60% also finding use.

Similarly, increases of at least one-, two-, three-, four- or five-fold as compared to reference or control samples show efficacy.

X. EXAMPLES

Example 1: Functional Assays

The purpose of this study was to characterize the functional activity CHA.7.518.1.H4(S241P) on human T cell function either alone or in combination with an anti-TIGIT and/or anti-PD-1 antibody in primary in vitro cell-based assays. We demonstrate that CHA.7.518.1.H4(S241P) enhanced cytokine production of viral antigen-specific CD8

T cells utilized as a model surrogate antigen to study CD8 T cell responses. Combination of CHA.7.518.1.H4(S241P) with anti-TIGIT antibody lead to an additive or, in some conditions, synergistic increase in T cell function. We also performed a triple combination of CHA.7.518.1.H4(S241P), anti-TIGIT, and anti-PD-1 and observed the greatest increase in T cell function co-cultured with PD-L1hi target tumor cells using the triple combination as compared to the double combination or the individual antibody. In a co-culture with PD-L1lo target tumor cells, the triple combination of CHA.7.518.1.H4(S241P), anti-TIGIT, anti-PD-1 did not further enhance T cell function compared to CHA.7.518.1.H4(S241P) and anti-TIGIT double combination, suggesting that CHA.7.518.1.H4(S241P) and anti-TIGIT treatment may be effective in patients who have low or negative PD-L1 expression. Taken together, we demonstrate an effect of CHA.7.518.1.H4(S241P) in enhancing human CD8+ T cell function, either individually or in combination with anti-TIGIT or anti-PD-1. This report describes the characterization of CHA.7.518.1.H4(S241P), a fully humanized IgG4 anti-PVRIG antibody, in cell based assays. CHA.7.518.1.H4(S241P) binds to PVRIG with high affinity and specificity, and blocks the interaction of PVRIG with PVRL2. In order to understand the effects of CHA.7.518.1.H4(S241P) on T cell function, we examined the effect of CHA.7.518.1.H4(S241P) on cytokines production in an in vitro assay. This assay was designed based on the 2 signal hypothesis of T cell activation: signal 1 comes from the activation of the T cell receptor; signal 2 are immunomodulatory receptors that help to enhance or inhibit the T cell responses. The design of these assays consist of a co-culture of human T cells with a target cell line pulsed with antigen peptide derived from a viral antigen (CMV). This signal provides "signal 1" of T cell activation through the T cell receptor. These target cell lines express endogenous PVRL2, and in this context PVRL2 provides "signal 2" to the T cell.

CMV: Tumor Cell Line Assay

CMVpp65-reactive T cells were expanded by thawing CMV-reactive donors according to CTL "Thawing Cryopreserved PBMC" protocol and 2e6 cells/ml were resuspended in medium (Gibco) supplemented with 1% glutamax (Gibco), 1% NEAA, penicillin/streptomycin (Gibco), 10% human AB serum (Corning), 1 ug/ml CMV peptide, 2 ng/ml IL-2 (R&D), and 10 ng/ml IL-7 (R&D). PBMCs were cultured for eight days with IL-2 and IL-7 replenished at day three and day six. At Day 8, cells were harvested, and replated in low dose IL-2 (100U/ml) at 2e6/ml in complete RPMI media for 5 days. At day nine, cells are phenotyped for CD8+ T cell purity and CMV tetramer reactivity. Cells were stained with 0.25 µL of CD3(clone: OKT)-allophycocyanin seven (APC-Cy7;Biolegend), 0.25 ul of CD8 (clone: H1T8a)-Alexafluor 488 (AF488; Biolegend), 0.125 µL of CD14 (clone: HCD14), 0.5 ul of CD19 (clone:HIBCD14), 0.5 ul of CD56 (clone:HCD56)-peridinin chlorophyll protein (PerCP;Biolegend), 1.25 ul µL of TIGIT (clone: MBSA43)-allophycocyanin (APC; e-Biosdence) or 1.25 µL of IgG4(In house)-isotype control (APC:Biolegend), 1.25 ul of CHA.7.518.1.H4(S241P)-allophycocyanin (In house), or 1.25 µL of IgG4-APC isotype control (In house) and 0.5 ul of PD-1 (clone: EH12.2H7)-Brilliant Violet 421 (BV421; Biolegend) or 1.25 ul of IgG1 (clone: MOPC21)-Brilliant Violet 421 (BV421;Biolegend). To assess the frequency of tetramer-reactive CD8⁻ T cells, unlabeled PBMCs were stained after cultivation) with 10 µL of iTAg Tetramer-HLA-A*02:01 CMV pp65 (NLVPMVATV) (SEQ ID NO: 1855)-phycoerythrin (PE, MBL-BION) for 30 min at room temperature. Cells were washed with PBS/BSA/azide solution and resuspended in buffer). Data was acquired using a Fortessa, and analyzed using FlowJo (Treestar) and Prism (Graphpad) software.

The target cells used in the co-culture assay were Panc.05.4 and Colo205 cell lines (ATCC). These cell lines were stained with 1.25 ul of PVR(SKII.4)-phycoerythrin (PE,Biolegend), 1.25 ul of PVRL2 (TX31)-peridinin chlorophyll protein (PerCP5.5;Biolegend), 2.5 ul PD-L1 (29E.2A3)-Brilliant Violet 785 (BV785;Biolegend) and 1.25 ul of HLA-A2 (BB7.2)-allophycocyanin (APC; Biolegend) expression. 1.25 ul of the corresponding isotype for each flurophore was also assessed (MOPC-21).

To setup the co-culture, tumor cell lines were harvested from culture and tumor cell lines pulsed with CMV peptide (Anaspec) for 1 hour at 37° C. with periodic mixing. After the incubation, the target cells were thoroughly washed, counted, and resuspended in complete RPMI medium. The assays were set up with a 1:1 ratio of T cells (100,000) to target cells (100,000). The target cells, T cells and 10 ug/ml of each antibody treatment were added together in a 96-well U bottom plate (Costar), and incubated for 24 hrs at 37° C. The antibody treatments include, CHA.7.518.1.H4(S241P) hIgG4, anti-TIGIT hIgG4 (Benchmark 26, Compugen), Anti-PD-1 hIgG4 (Benchmark 3, Compugen) and a human IgG4 isotype control (Compugen). In order to match the total antibody concentration across all individual and combination groups, additional human IgG4 isotype control was added in to single or double combination conditions to a final total antibody concentration of 30 ug/ml. After the 24 hr incubation period, co-culture supernatants were analyzed for secreted cytokines, including IL-2, IL-4, IL-5, IL-6, IL-9, IL-10, IL-13, IL-17A, IL-17F, IL-21, IL-22, TNF-α, and/or IFN-γ, with the cytometric bead array (CBA) human Th1/Th2/Th17 cytokine kit (BD Biosciences), or with the LEGENDplex™ Human Th cytokine kit (BioLegend). Data was acquired using a Fortessa, and analyzed using FlowJo (Treestar) and Prism (Graphpad) software 1. Results and Discussion a. CMV T Cell Assay: CMVpp65 Reactive T Cells Express PVRIG, TIGIT, and PD1

Human cytomegalovirus (CMV) is a widespread persistent β-herpesvirus that infects a high percentage of the population, with slightly lower seroprevalance in Western Europe and the United States (Cannon M J et al. 2010). The immune system of patients with chronic viral infections or cancer is often impaired in function and is unable to mount an effective response against the virus or to recognize and eliminate malignant cells. In these patients, expression of inhibitory receptors increase and this was found to be associated with T-cell dysfunction. Thus, the upregulation of negative checkpoints receptors may serve as potential targets for the reversal of T cell exhaustion. CD8 T cells specific to CMV pp65 protein have been well characterized and these CMV specific T cells can be used to study the role of modulatory receptors on T cells.

Stimulation of HLA-A2+ donor PBMCs using CMV pp65 peptide, IL-2 and IL-7 resulted in a strong expansion of CMV pp65-specific T cells to purities ranging from 50-90% as determined by tetramer staining. FIG. 8A shows the percentage of CMV pp65 specific T cells from several donors after expansion. The surface expression of PVRIG, TIGIT and PD-1 on T cells was assessed from CMV+ donors, and compared to respective isotype for receptor expression by flow cytometry. CMV pp65 specific T cells expressed PVRIG (median gMFI ratio: 7), TIGIT (median gMFI ratio: 37), and PD1 (median gMFI ratio: 2) on day 9 of activation (FIG. 8B).

We further assessed the kinetics of expression of PVRIG, TIGIT, and PD1 relative to the expansion of CMV pp65 specific T cells in a time course. For each donor, the frequency of CMVpp65 reactive CD8+ T cells are plotted over time (FIG. 9A). A significant expansion in the frequency of CMVpp65 reactive T cells (range: 50-97%) was observed in all donors, with donor 198 initially expanding at day three (Day 3 CMV+percentage: 85.7%). However, donor 198 had a loss of CMV tetramer expression at day 6 (Day 6 CMV+percentage: 50.4%). PVRIG, TIGIT and PD-1 expression of CMV-specific $CD8^+$ T cells was assessed by flow cytometry over the twelve-day time course. In donor 4, donor 198 and donor 210, TIGIT expression among CMVpp65 specific $CD8^+$ T cells increased during the twelve-day expansion period (mean gMFIr expression of three donors TIGIT expression of three donors, Day 0 gMFIr: 1.2, Day 12 gMFIr: 47) (FIG. 9B). PVRIG expression of CMV+ T cells also increased (mean gMFI PVRIG of three donors, Day 0 gMFIr: 0.92, Day 12 gMFIr: 8.6) (FIG. 6C). PD-1 expression was also assessed, and we observed minimal induction of expression (mean gMFIr PD-1, Day 0 gMFI: 0.93, Day 12 gMFI: 2) (FIG. 9C).

b. CHA.7.518.1.H4(S241P), Anti-TIGIT, and Anti-PD1 Antibodies Enhanced IFN-γ Secretion With the rationale that the upregulation of TIGIT, PVRIG, and PD-1 expression by CD8 CMV cells correlates with T cell dysfunction, we aimed to evaluate the effects of PVRIG, TIGIT, and PD-1 blockade on the capacity for pro-inflammatory cytokine production. CMVpp65 reactive T cells from 2 donors were co-cultured with CMV peptide loaded PD-L1hi (Panc04.05) and PD-L1lo (Colo205) tumor cell lines prior to flow cytometric analysis of cytokine production (FIG. 10).

In the Panc.04.05 (PD-L1hi) co-culture, we observed that anti-TIGIT single blockade increased IFN-γ production compared with IgG control mAbs, whereas CHA.7.518.1.H4(S241P) or anti-PD-1 had minimal effect (FIG. 11). Dual anti-TIGIT and CHA.7.518.1.H4(S241P) blockade synergistically and consistently increased the cytokine production of CD8+ T cells as compared with CHA.7.518.1.H4(S241P) or anti-TIGIT single blockade alone. In donor 4, a further increase in IFN-γ was observed with a triple combination of CHA.7.518.1.H4(S241P), anti-TIGIT, and anti-PD-1, suggesting that when PD-L1, PVR, and PVRL2 are expressed at high levels on tumor cells, the largest increase in T cell activation is achieved with a triple combination. In Colo205 (PD-L1lo) co-cultures, anti-TIGIT blockade alone increased IFN-γ secretion whereas CHA.7.518.1.H4(S241P) or anti-PD1 antibody had minimal effect, similar to the results with Panc.04.05 co-culture. Also similar to the Panc.04.05 co-culture, dual blockade of anti-TIGIT and CHA.7.518.1.H4(S241P) also synergistically increased IFN-γ as compared anti-TIGIT, anti-PD-1, or CHA.7.518.1.H4(S241P) alone, and to a greater magnitude of either CHA.7.518.1.H4(S241P) or anti-TIGIT in combination with anti-PD-1. In contrast to Panc.04.05 (PD-L1hi), the triple combination condition for Donor 4 was not better than the dual combination of CHA.7.518.1.H4(S241P) and anti-TIGIT in the Colo205 co-culture (PD-L1lo), suggesting when PVR and PVRL2 are expressed at high levels and PD-L1 at a low level on tumor cells, double combination CHA.7.518.1.H4(S241P) and anti-TIGIT led to the greatest increase of IFN-γ expression. These findings demonstrate that TIGIT and PVRIG blockade were sufficient to enhance CD8+ T cell responses in PD-L1lo tumors and that a triple combination led to the greatest increase in T cell activation in PD-L1hi tumors.

c. Summary

Human anti-CMV T cell responses are utilized as an in-vitro antigen-specific method to assess checkpoint inhibitor antibody functional capability. We observed that co-blockade of TIGIT and CHA.7.518.1.H4(S241P) lead to a greater restoration of T cell function compared with a single antibody blockade, suggesting that disrupting the TIGIT and PVRIG pathway may be more important that disrupting the PD1 pathway in CD8-tumor cell co-cultures. Furthermore, we observed that triple blockade using antibodies to PD-1, TIGIT, and PVRIG can result in the greatest increase in IFN-γ when PD-L1 positive tumor cells or immune cells are >1%, which is equivalent to PD-L1 high expression levels. These findings demonstrate that TIGIT and PVRIG blockade were sufficient to enhance $CD8^+$ T cell responses in PD-L1lo tumors and that a triple combination led to the greatest increase in T cell activation in PD-L1hi tumors.

The present invention provides methods comprising: a) providing a cell population from a tumor sample from a patient; b) staining said population with labeled antibodies that bind: i) TIGIT protein; ii) PVRIG protein; iii) PVR protein; iv) PD-1 protein; v) PD-L1 protein; vi) PVRL2; and vii) a relevant isotype control for the antibodies in i)-vi); c) running fluorescence activated cell sorting (FACS); d) for each of TIGIT, PVRIG, PVR, PD-1, PVRL2 and PD-L1, determining the percentage of cells in said population that express the protein relative to said isotype control antibody; wherein if the percentage of positive cells is >1% for either TIGIT or PVR, and for either PVRIG or PVRL2, and for either PD-1 or PD-L1, proceeding to step e); and e) administering antibodies to TIGIT, PVRIG, and PD-1 to said patient.

The present invention provides a method comprising: a) providing a cell population from a tumor sample from a patient; b) staining said population with labeled antibodies that bind: i) TIGIT protein; ii) PVRIG protein; iii) PVR protein; iv) PD-1 protein; v) PD-L1 protein; vi) PVRL2; and vii) a relevant isotype control for the antibodies in i)-vi); c) running fluorescence activated cell sorting (FACS); d) for each of TIGIT, PVRIG, PVR, PD-1, PVRL2 and PD-L1, determining the percentage of cells in said population that express the protein relative to said isotype control antibody; wherein if the percentage of positive cells is >1% for either TIGIT or PVR, and for either PVRIG or PVRL2, and for either PD-1 or PD-L1, proceeding to step e); and e) administering antibodies to TIGIT, PVRIG, and PD-1 to said patient.

The present invention provides a method comprising: a) providing a cell population from a tumor sample from a patient; b) staining said population with labeled antibodies that bind: i) TIGIT protein; and ii) PVR protein; and iii) a relevant isotype control for the antibodies in i)-ii); c) running fluorescence activated cell sorting (FACS); d) for each of TIGIT and PVR, determining the percentage of cells in said population that express the protein relative to said isotype control antibody; wherein if the percentage of positive cells is >1% for either TIGIT or PVR, proceeding to step e); and e) administering antibodies to TIGIT, PVRIG, and PD-1 to said patient.

The present invention provides a method comprising: a) providing a cell population from a tumor sample from a patient; b) staining said population with labeled antibodies that bind: i) PVRIG protein; and ii) PVRL2 protein; and iii) a relevant isotype control for the antibodies in i)-ii); c)

running fluorescence activated cell sorting (FACS); d) for each of PVRIG and PVRL2, determining the percentage of cells in said population that express the protein relative to said isotype control antibody; wherein if the percentage of positive cells is >1% for either PVRIG or PVRL2, proceeding to step e); and e) administering antibodies to TIGIT, PVRIG, and PD-1 to said patient.

The present invention provides a method comprising: a) providing a cell population from a tumor sample from a patient; b) staining said population with labeled antibodies that bind: i) PD-1 protein; and ii) PD-L1 protein; and iii) a relevant isotype control for the antibodies in i)-ii); c) running fluorescence activated cell sorting (FACS); d) for each of PD-1 and PD-L1, determining the percentage of cells in said population that express the protein relative to said isotype control antibody; wherein if the percentage of positive cells is >1% for either PD-1 or PD-L1, proceeding to step e); and e) administering antibodies to TIGIT, PVRIG, and PD-1 to said patient.

Example 2: Expression of PVRIG and PVRL2 in Human Cancer and Normal Adjacent Tissues The purpose of this study was to examine the expression of PVRIG and PVRL2 in human tumor and normal adjacent samples. PVRIG was observed to be expressed highest on CD8+ T cells, followed by NK cells, CD4–CD8– T cells, and by CD4+ T cells. No expression was observed on monocytes, mDCs, pDCs, or tumor cells. Of the tumor types examined, endometrial, lung and kidney tumors expressed the highest levels of PVRIG on lymphocytes. A comparison of PVRIG expression on CD4+ and CD8+ T cells from normal adjacent tissues compared to tumor tissues from the same patient showed a significant increase in PVRIG in tumor tissues. A correlation analysis of the magnitude of PVRIG expression with the magnitude of TIGIT or PD-1 expression showed a positive and significant correlation on CD4 and CD8 T cells. In addition, a co-expression single cell analysis of PD-1, TIGIT, and PVRIG showed that PVRIG is co-expressed with PD-1 and TIGIT on a subset of cells. These data support the conclusion that combination blockade of PVRIG with TIGIT and/or PD-1 will lead to increased T cells responses. The ligand for PVRIG, PVRL2, was expressed on myeloid cells (monocytes, mDCs, pDCs) and on CD45– non-immune cells from multiple tumors, likely composed of tumor epithelium and stromal cells. A comparison of PVRL2 on cells derived from normal adjacent vs tumor tissue showed significant increase in expression of PVRL2 on monocytes and CD45– non-immune cells. A correlation analysis of the magnitude of PVRL2 expression with the magnitude of PD-L1 expression showed a positive and significant correlation on CD45– non-immune cells and monocytes. In these samples, we also assessed the co-expression of PVRIG and PVRL2 in the same sample to understand which tumor type has high co-expression of both receptor and ligands. Of the tumor types examined, we observed high expression of both PVRIG and PVRL2 in the majority of endometrial samples, kidney samples, and lung tumor samples. In summary, these data demonstrate that PVRIG and PVRL2 are expressed on leukocytes and tumor cells from the tumor microenvironment and suggest that this pathway can be exploited to regulate anti-tumor responses.

We examined the expression of PVRIG and PVRL2 using flow cytometry on cells from dissociated human tumors and matched normal adjacent tissues from multiple different tissues. The expression of immune regulators in the tumor can be used to help predict which tumor types or patients can be most responsive to a specific therapy.

Healthy human peripheral blood mononuclear cells (PBMC) donors were obtained from the Stanford Blood Bank. Buffy coats or LRS products were diluted 1:1 in 1×PBS+2% FBS and PBMCs were isolated by Ficoll-Paque gradient (Sigma). Purified PBMCs were washed 2× with PBS+2% FBS and banked in liquid nitrogen. Tumor and normal adjacent tissue (NAT) samples were provided by the Cooperative Human Tissue Network, a National Cancer Institute supported resource. The tumor type was determined based on reviewing the pathology report for each sample. The number of samples per tumor type where we examined PVRIG and PVRL2 expression is reported below.

| Target | Breast | Colon, Rectal, Stomach | Endometrium & Uterine | Head&Neck | Kidney | Lung | Prostate | Ovary |
|---|---|---|---|---|---|---|---|---|
| PVRIG | 4 | 15 | 24 | 4 | 14 | 8 | 9 | 5 |
| PVRL2 | 6 | 21 | 28 | 5 | 16 | 11 | 12 | 10 |

1. Tumor Dissociation Protocol

Tumor and NAT samples were cut into small pieces with a scalpel and transferred to GentleMACs™ C tubes (Miltenyi Biotec) containing an enzyme mix. Samples were dissociated on GentleMACs (Miltenyi Biotec) as per the manufacturer's protocol. After dissociation, cells were filtered through a 100 μm filter prior to FACS staining.

2. Antibodies and Reagents:

To identify immune and non-immune cell populations, the following antibodies were at the manufacturer's recommended concentrations:

TABLE 2

The antibodies used to identify specific cell subsets is shown.

| Antibody | Flourophore | Clone | Vendor | Cat |
|---|---|---|---|---|
| CD45 | Alexa Fluor 700 | HI30 | BioLegend | 304024 |
| CD3 | APC Cy7 | OKT3 | BioLegend | 317342 |
| CH8 | BV 785 | RPA-T8 | BioLegend | 301046 |
| CD33 | BV711 | WM53 | BioLegend | 303424 |
| CD25 | BV 650 | BC96 | BioLegend | 302634 |
| CD127 | BV 605 | A019D5 | BioLegend | 351334 |
| CD14 | BUV395 | MoP9 | BD Pharmingen | 563562 |
| CD4 | BUV496 | SK3 | BD Pharmingen | 564651 |
| CD56 | PE Dazzle | HCD56 | BioLegend | 318348 |

The following antibodies were used at 5 ug/ml in the isotype control cocktail.

TABLE 3

The antibodies used as isotype controls for the targets of interest is shown.

| Antibody | Flourophore | Clone | Vendor | Cat |
|---|---|---|---|---|
| mIgG1 | AF647 | in house | Compugen | In-house |
| hIgG4 | PE | in house | Compugen | In-house |
| mIgG1 | BV421 | MOPC21 | BioLegend | 400158 |
| mIgG1 | PerCP Cy5-5 | MOPC21 | BioLegend | 400150 |
| mIgG1 | PE Cy7 | MOPC21 | BioLegend | 400126 |
| mIgG1 | FITC | MOPC21 | BioLegend | 400110 |

The following cocktail was used to stain the targets of interest at 5 ug/ml:

TABLE 4

The antibodies used to analyze the targets of interest are shown

| Antibody | Flourophore | Clone | Vendor | Cat |
|---|---|---|---|---|
| PDL1 | AF647 | BM1(M1) | Compugen | In-house |
| PVRIG | PE | 518(H4) | BioLegend | 93930 |
| PD1 | BV421 | EH12.2H7(M1) | BioLegend | 329920 |
| PVR | PerCP Cy5-5 | SKII.4 (M1) | BioLegend | 337612 |
| PVRL2 | PE Cy7 | TX31 (M1) | BioLegend | 337414 |
| TIGIT | FITC | MBSA43(M1) | eBioscience | 11-9500-42 |

All isotype control antibodies and target antibodies were used at 5 ug/ml final concentration.

3. FACS Staining $1 \times 10^6$ cells of PBMCs or dissociated tumor cells were seed into a 96-well V-bottomed plate for staining. Samples were first stained with Aqua Live Dead (Thermo Scientific) to distinguish live cells from dead cells and with a cocktail of anti-CD16 (Biolegend), anti-CD32 (Thermo Scientific), anti-CD64 (Biolegend) Abs to block Fc receptors. Samples were washed twice with FACS buffer and stained with a relevant isotype control for the antibodies for the antibodies used or a target antibody cocktail described in the "Antibodies and Reagents" section. All staining was done for 30 minutes at 4 C. Samples were then washed twice and acquired on the BD Fortessa flow cytometer. Analysis was done using FlowJo, gating on specific populations as specified in Table 1, above (all gated on live cells).

From each population with at least 100 cells, MFI values were exported and a MFI ratio (MFIr) calculated by dividing the MFI of a target by the MFI of the relevant isotype control. MFIr value greater than one denotes positive expression detected.

4. Results and Discussion a. PVRIG is Expressed on TILS from Multiple Tumor Types and is Co-Expressed with TIGIT and PD1

To examine the expression of PVRIG on cells derived from tumors by flow cytometry, tumors were dissociated and stained for immune cell lineage markers to identify immune and non-immune cell subsets and for PVRIG, TIGIT, PD1, PVRL2, and PVR to examine expression of these targets on these subsets. Expression of PVRIG was detected on CD4+ T cells, CD8+ T cells, CD4−CD8− T cells, and NK cells from breast, colon/rectal/stomach, endometrium, head & neck, lung, kidney, prostate, and ovarian tumors (FIG. 12A). Across all tumor tissues examined, PVRIG was expressed, from highest to lowest, on CD8+ T cells, NK Cells, CD4− CD8− T cells, and CD4+ T cells. No PVRIG expression was detected on monocytes, mDCs, pDCs, or non-immune cells (FIG. 1B). As CD8+ T cells and NK cells are known to be important cytotoxic lymphocytes within the immune system, this suggests the PVRIG can directly modulate the activity of these cytotoxic lymphocytes.

We next examined the expression of magnitude of PVRIG in relation to the magnitude of TIGIT and PD-1 on tumor infiltrating T cells. For this analysis, we focused the analysis on endometrial samples because we had sufficient number of samples with which to perform the correlation analysis. PVRIG significantly and directly correlated with TIGIT and PD1 expression on both CD4 and CD8 T cells, suggesting that these molecules are co-regulated within the TME (FIG. 13).

We further examined co-expression of PVRIG, TIGIT, and PD1 on a single cell basis on CD8 T cells. Co-expression of PVRIG with PD-1 and with TIGIT was observed on a representative lung and kidney cancer (FIG. 14).

b. PVRIG Expression is Significantly Enhanced on T Cells from the Tumor Versus Normal Adjacent Tissue For a subset of colon/rectal/stomach, endometrium, kidney, lung or ovarian tumors, we were able to obtain matched tumor and normal adjacent tumor (NAT) samples from the same donor. Using these matched samples, we compared the expression of PVRIG and PD1 on cells derived from NAT or tumor samples to determine if there is modulated expression in the tumor compared to healthy tissues (FIG. 15). Overall, PVRIG was significantly increased on CD4 and CD8 T cells derived from tumor tissue as compared to matched normal adjacent (FIG. 15A). Within tumor types, PVRIG was upregulated by at least 2 fold in 3 of 9 colon tumors, 1 or 2 endometrium tumors, 4 of 11 kidney tumors, and 4 of 5 lung tumors (FIG. 15A). In the same samples, we also evaluated PD-1 expression. A correlation analysis between PVRIG fold change (between NAT and tumor) and PD-1 fold change on CD4 and CD8 T cells showed a positive and significant correlation in these samples, suggesting that these molecules could be co-regulated in similar manner in the tumor.

c. PVRL2 is Expressed on Myeloid and CD45− (Non-Immune) Cells from Multiple Tumors In the same samples from which we examined PVRIG expression, we also examined the expression of PVRL2, the ligand for PVRIG. PVRL2 expression was detected on 2 major cell subsets, myeloid cells which include monocytes, mDC, and pDC populations, and CD45− non-immune cells, likely composed of tumor epithelium, stromal cells, and endothelial cells (FIG. 16).

PVRL2 expression on CD45− non-immune cells was detected on cells from breast, colon/rectum/stomach, endometrial, lung, prostate, and ovarian tumors (FIG. 17). The highest expression median expression of PVRL2 was detected on endometrium and ovarian tumors.

On immune cells, PVRL2 was expressed on myeloid cells from breast, colon/rectum/stomach, endometrium/uterus, head and neck, lung, kidney, prostate, and ovary tissues(.

FIG. 18). The median expression of PVRL2 on myeloid cells (monocytes, mDCs, pDCs) was comparable across tumor types.

Comparing tumor tissue with normal adjacent tissue, PVRL2 expression was significantly increased on tumor CD45− cells or on monocytes from tumor tissues (FIG. 19). PVRL2 expression on monocytes or CD45− cells was induced by at least 2 fold in the tumor compared to normal adjacent in 5 of 9 colon tumors, 1 of 2 endometrium tumors, 5 of 11 kidney tumors, 4 of 5 lung tumors, and 1 of 1 ovarian tumors. These data support increased expression of PVLR2 on tumor cells and on immune cells within the tumor. A correlation analysis between of PVRL2 fold change (between NAT and tumor) and PD-L1 fold change on CD45− cells and monocytes showed a positive and significant correlation in these samples, suggesting that these molecules could be co-regulated in similar manner in the tumor.

d. PVRIG and PVRL2 are Co-Expressed in the Same Tumor

We further assessed which tumor types have high expression of both PVRIG on T cells and PVRL2 on either monocytes and tumor cells. In this sample set, tumors from endometrium, lung, and kidney tissues displayed high expression of both PVRIG on T cells and PVRL2 on either monocytes or CD45− cells (FIG. 20), suggesting that these tumor types may be more responsive to CHA.7.518.1.H4 (S241P) treatment.

e. Conclusion

The results from these studies demonstrate that PVRIG is expressed on effector lymphocytes such as CD8 T cells and NK cells within the tumor microenvironment. Both PVRIG and PVRL2 were expressed in multiple tumor samples from breast, colon/rectum/stomach, endometrial, lung, prostate, and ovarian tumors. Expression of PVRIG on T cells was significantly increased in tumor tissues as compared to matched normal adjacent tissues. Furthermore, a significant direct correlation was observed between PVRIG and PD-1 and PVRIG and TIGIT expression on CD4 and CD8 T cells from endometrial samples. On a single cell basis, co-expression of PVRIG with PD1 or with TIGIT was observed on CD8 T cells. The ligand for PVRIG, PVRL2, is expressed on antigen presenting cells (monocytes, mDCs, pDCs) and also on CD45− cells (presumably composed of epithelial, stromal, endothelial cells) from multiple tumor tissues. Induction of PVRL2 expression was detected on cells derived from tumor as compared with normal adjacent tissues. The cellular expression profile of the receptor and ligand suggest a role for this pathway in regulating effector lymphocyte responses for multiple tumor types.

Example 3: Expression of PVRL2 and PD-L1 in Human Cancer and Normal Tissues by IHC The purpose of this study was to examine the expression of PVRL2 and PD-L1 in human healthy and cancer tissue. Two antibodies to PVRL2 were identified to stain for PVRL2 in formalin fixed paraffin embedded (FFPE) fixed samples. PD-L1 was assessed using a commercially validated antibody. Using these antibodies, we examined expression of PVRL2 and PD-L1 in serial tissue sections of a tumor microarray (TMA) composed of breast, colon, lung, ovarian, and skin tissues. PVRL2 expression was observed to be enhanced in breast, colon, lung, ovarian, and skin cancers as compared to healthy tissues. Similar staining was observed between the two PVRL2 antibodies, helping to corroborate the results obtained. PD-L1 expression was also increased in breast, colon, lung, ovarian, and skin cancers as compared to healthy tissues. Expression of PVRL2 was observed on tumor epithelium and also on infiltrating immune cells. There was a higher incidence of PVRL2 expression than PD-L1 expression in these tumor samples. Individual tumor samples were further grouped by PD-L1 negative and positive expression, and PVRL2 expression analyzed in these subgroups. All PD-L1 positive tumors also expressed PVRL2, providing a rationale for combination treatment in tumors. In PD-L1 negative tumors, PVRL2 expression was detected in a subset of these samples, providing a rationale for targeting the PVRL2 pathway in PD-L1 negative tumors. Taken together, these data demonstrate that PVRL2 expression was enhanced in the tumor microenvironment from breast, colon, lung, ovarian, and skin cancer and provide a rationale for monotherapy and combination treatment with agents targeting the PVRL2 pathway.

Protocols

Antibodies

Anti-PVRL2 (Abcam ab135246, Sigma HPA-012759) and anti-PDL1 (SpringBio Sp142) were used in this study. Isotype control antibody (Rabbit IgG) was used as the negative control.

IHC Staining

Breast, colon, lung, ovarian, skin tumor microarrays were obtained from. Each microarray contains healthy tissues from 2-4 donors and tumor tissue from 30-40 donors, present in duplicates on the slide. Anti-PVRL2 Abcam ab135246 staining was performed at 1:250 dilution with no heat-induced antigen retrieval (HIER). Anti-PVRL2 (Sigma HPA-012759) was used at 0.1 ug/ml with HIER at pH 9.5. Anti-PD-L1 (SpringBio SP142) was used at 1 ug/ml with HIER at pH6.2 based on the manufacturer's recommendation. A matching rabbit IgG isotype control was used at each of the relevant conditions. Each core was qualitatively scored based on: No staining (score 0), partial positive (score 1), positive (score 2), strong positive (score 3) by 2 individual operators. In cases of a score discrepancy between the 2 operators, the sample was reassessed by both operators for a final score. The score from the 2 cores derived from the same tumor were averaged and one score obtained for each tumor. Scores were plotted and samples were grouped by pathology data provided by the vendor.

RESULTS AND Discussion

PVRL2 and PD-L1 Expression are Increased in Breast, Colon, Lung, Ovarian, and Skin Cancers Two anti-PVRL2 antibodies (ab135246, HPA-012759) were tested for ability to assess PVRL2 expression in formalin fixed paraffin embedded tissues. Expression of PVRL2 and PD-L1 was assessed serial sections of a tumor microarray of breast, colon, lung, ovarian and skin cancers. Expression of PVRL2 and PD-L1 was increased in breast, colon, lung, ovarian, and skin cancers (FIG. 21).

PVRL2 is Expressed in PD-L1 Positive and PD-L1 Negative Tumors.

As the expression of PVRL2 and PD-L1 was conducted on serial sections of the same TMA, we were able to examine the expression of PVRL2 and PD-L1 in each of these tumors from the same portion of the tumor (FIG. 22). A subset of PD-L1 negative tumor samples, in particular lung, ovarian, breast tumors, expressed PVRL2 (as defined by at least partial positive) as detected by both anti-PVRL2 antibodies. These data show that PVRL2 can be expressed in PD-L1 negative tumors. In contrast, all PD-L1 positive tumors expressed PVRL2 as detected by both PVRL2 antibodies.

PVRL2 is Expressed on the Epithelial Cells and on the Immune Compartment on the Invasive Front The spatial expression of immune checkpoints at the invasive front of a tumor is important in regulating the anti-tumor response. Known checkpoint targets such as PD-1 and PD-L1 have prominent expression at the invasive front. As these TMAs are generated from punch biopsies and do not contain the whole tumor, we examined these samples for the presence of immune infiltrate at the invasive front of the tumor. We identified 1 sample where we observed PVRL2 expression in the immune infiltrate and on the tumor epithelium (FIG. 23). PD-L1 expression was observed on the immune infiltrate, further suggesting this could be the invasive front of a tumor.

Conclusion

These results demonstrate the PVRL2 expression is enhanced in breast, colon, lung, ovarian, skin tumors as compared to healthy tissue from the same organs. PVRL2 is expressed on both tumor epithelium and on infiltrating leukocytes. We further demonstrate that all PD-L1 positive tumors express PVRL2, suggesting that agents that target PVRL2 pathway may be efficacious in combination with PD-1/PD-L1 inhibitors. In addition, PVRL2 expression was detected in PD-L1 negative tumors, suggesting that agents that target PVRL2 pathway may be efficacious in PD-L1 negative tumors.

Example 4: Antitumor Responses of Mono, Dual and Triple Combination Antibody Treatments in the CT26 Tumor Model Rationale and Objectives To examine whether antibody blockade of PVRIG, TIGIT and PD-L1 can enhance tumor growth inhibition and survival in a syngeneic mouse tumor model compared to mono or dual antibody treatments.

Materials and Methods

In Vivo Tumor Model

CT26 colon carcinoma cells (ATCC) were cultured in RPMI 1640 with 10% FBS, and 100 ug/mL penicillin/streptomycin. For tumor implantation, $5 \times 10^5$ CT26 cells were injected subcutaneously into the right flank of female, 8-week-old BALB/c mice. Following tumor randomization, the antibodies were administered by intra-peritoneal (i.p.) injection, starting on day 7 post tumor inoculation when tumors reached the volume of 60-90 mm³, and continued for 3 weeks for a total of 6 administrations. Tumor size was measured with electronic caliper every 2-3 days and was reported as $0.5 \times W^2 \times L$ mm³ . . . . Mice were sacrificed at either study termination or at the clinical endpoints, including tumor volume ≥3250 mm³, tumor ulceration, body weight loss≥20%, or moribund appearance.

Antibodies

The chimeric anti-mouse PVRIG antibody (Clone 407, internal production) used in these studies was engineered as a mouse IgG1 (mIgG1) antibody. This antibody was shown to bind to 293HEK cells over-expressing mouse PVRIG, and to block the binding of the ligand, mouse PVRL2. The anti-mouse PD-L1 mIgG1 antibody (Clone YW243.55.S70) was generated according to the description in WO/2010/077634. The anti-mouse TIGIT mIgG1 antibody (Clone 11A11) was generated according to the description in WO2016/028656. Synagis IgG1 was used as isotype control and produced internally. Antibodies were formulated in sterile PBS with low endotoxin (<0.05 EU/mg). The anti-PVRIG antibody was administered at a dose of 10 mg/kg, anti-PD-L1 at 5 mg/kg, and anti-TIGIT at 18 mg/kg.

Statistical Analysis

Two-way ANOVA with repeated measures, followed by two-way ANOVA with repeated measures for selected pairs of groups was determined by J UMP software (Statistical Discoveries™). Analyses of tumor growth measurements were performed by comparing tumor volumes measured on the last day on which all study animals were alive. Statistical differences in percentage of mice tumor free were determined by a Log Rank Mantel-Cox test. Values of P<0.05 were considered significant. * p<0.05;  p<0.01; * p<0.001.

Results

In Vivo Efficacy of Anti-TIGIT and Anti-PVRIG Antibodies in Combination with Anti-PD-L1 Antibody The in vivo efficacy of combinational therapy of mouse PVRIG, TIGIT and PD-L1 blockade was evaluated in mouse syngeneic CT26.WT ectopic subcutaneous tumor model. Treating tumor bearing mice with the anti-PVRIG antibody in combination with an anti-PD-L1 antibody resulted in tumor growth inhibition (TGI) of 47% compared to isotype control. However, in this study no benefit was observed with the dual combination of anti-PD-L and anti-PVRIG antibodies compared to anti-PD-L1 antibody treatment alone. The blockade of TIGIT in the triple combination (anti-PVRIG, anti-TIGIT and anti-PD-L1) resulted in a significant improvement in TGI when compared to other dual combination treatments with the anti-TIGIT antibody (anti-PDL-1+anti-TIGIT, anti-PVRIG+anti-TIGIT, and anti-PDL-1+anti-TIGIT, which corresponded to 29%, 61%, and 55% TGI, respectively) (FIGS. 24A and C). The triple combination resulted in higher response rates (55% vs 40%) and promoted durable antitumor activity with a trend for higher survival rate until Day 35 (FIG. 24B).

Example 5: PVRIG Antagonism Enhances T Cell Effector Function And Reduces Tumor Growth Abstract Despite recent advances, the majority of patients do not derive long term benefit from checkpoint inhibitors. PVRIG is a novel immune suppressive receptor of the DNAM/TIGIT family and we demonstrate here a role of PVRIG in regulating anti-tumor responses. PVRIG binds to PVRL2 and displays significantly enhanced expression on tumor infiltrating lymphocytes as compared to lymphocytes from normal tissues. PVRIG antagonism enhanced human T cell activation and combination of PVRIG with PD-1 or TIGIT inhibitors further synergistically increased lymphocyte function. We next addressed the role of PVRIG in preclinical tumor models. PVRIG$^{-/-}$ mice displayed significantly increased T cell activation in vitro and reduced MC38 tumor growth that was mediated by increased CD8 effector function. Antagonistic anti-PVRIG antibody significantly reduced tumor growth in combination with anti-PD-L1 or when tested in TIGIT$^{-/-}$ mice. In summary, we demonstrate that PVRIG-PVRL2 pathway was induced in human cancers and that antagonizing PVRIG-PVRL2 interactions resulted in increased T cell function and reduced tumor growth.

State of Significance

These data demonstrate that PVRIG is a promising target for the treatment of cancer and provide the rationale for testing a PVRIG inhibitor, CHA.7.518.1.H4(S241P), as a novel cancer immunotherapy agent either as monotherapy or in combination with TIGIT or PD1 blockade.

Introduction

Increasing evidence demonstrate that endogenous immune responses are critical in sculpting the initiation, progression, and suppression of cancer (1) (2). The immune status of patients as well as the content of tumor-infiltrating leukocytes (TILs) within the tumor microenvironment (TME) are key prognostic indicators of not only cancer survival rates, but also how patients respond to therapy (3) (4). T cells are a key component of TILs that can invoke an anti-tumor response, and most anti-tumor immune responses ultimately rely on the functionality of effector lymphocytes cells. An enrichment of CD8 T cells in the TME of a patient's tumor, as well as other factors that bias an immune response towards an effective CD8 T cell response such as mutational load and a Th1 polarized TME, are all key prognostic indicators for a favorable anti-tumor immune response (5) (6).

A key observation across many solid tumors is that effector T cells have an activated or 'exhausted' phenotype within the TME (7). This indicates that although T cells within the TME have initially seen cognate antigen, been activated, and trafficked to the tumor, they are subsequently not capable of invoking an effective anti-tumor response. Pre-activated or exhausted T cells are defined by increased surface expression of co-inhibitory receptors, such as PD-1 and CTLA-4 (8). Therapeutically targeting these co-inhibitory receptors with antibodies that inhibit interactions with their cognate ligands have shown remarkable clinical efficacy in patients with multiple advanced cancers (9). Mechanistically, it has been shown that targeting these co-inhibitory receptors leads to the expansion of already tumor-reactive T cells that pre-exist in the TME and to the production of T cell pools with widened T cell receptor diversity (10) (11) (12). Although checkpoint inhibitors currently in the clinic have revolutionized cancer treatment and demonstrated the power of the immune system in combating cancer, many patients still relapse and/or do not respond to treatment. Consequently, increased understanding of the immune response in cancer and targeting additional immune-based pathways will lead to additional therapeutic treatments.

Among these novel pathways, a group of receptors and ligands within the nectin and nectin-like family are currently under investigation as potential novel cancer immunotherapies. Receptors within this family include DNAM-1 (CD226), CD96 (TACTILE), TIGIT, and more recently, PVRIG (CD112R) (13) (14) (15). Of these molecules, DNAM is an activating receptor within this subfamily, binding to 2 ligands, PVR (CD155) and PVRL2 (CD112), to deliver an activating signal to lymphocytes (16). Two receptors in this family have been shown to inhibit human lymphocyte function, TIGIT, and more recently, PVRIG (17) (18). TIGIT is reported to have a high affinity interaction with PVR, a much weaker affinity to PVRL2, and has been shown to inhibit both T cell and NK cell responses by delivering an inhibitory signal into lymphocytes through its ITSM motif (19) (20). More recently, PVRIG was shown to bind with high affinity to PVRL2 and to deliver an inhibitory signal through its ITIM motif (15). In both cases, the affinity of TIGIT to PVR and of PVRIG to PVRL2 is higher than the affinity of DNAM to either PVR or PVRL2, suggesting TIGIT and PVRIG can outcompete PVR and PVRL2 from DNAM, providing an indirect mechanism by which TIGIT and PVRIG can reduce T cell function. Within this family, PVR is also a ligand for CD96. The function of CD96 has been reported to be inhibitory on mouse lymphocytes (21) but activating on human lymphocytes (22). Based on these data, we postulate on human lymphocytes that 2 receptors, TIGIT and PVRIG, bind with high affinity to PVR and PVRL2, respectively, to deliver inhibitory signals to dampen T cell function.

Although human PVRIG has been shown to inhibit T cells response in one recent report, the role of PVRIG and PVRL2 in cancer immune surveillance is not well understood. In particular, the expression profile of this pathway in cancers and the role of PVRIG in regulating CD8 T cell anti-tumor responses has not been reported. Furthermore, functional characterization of the mouse PVRIG gene and the effect of disrupting PVRIG-PVRL2 interaction in vivo in pre-clinical tumor models has not been reported. Herein, we elucidated the role of PVRIG in a cancer setting by reporting on PVRIG and PVRL2 expression profile in cancer and the effect of PVRIG antagonism in tumor cell co-culture assays and in preclinical tumor models. We demonstrate that PVRIG has a differentiated expression profile on T cell subsets compared to TIGIT or CD96 and that PVRIG and PVRL2 expression were induced in cancer compared to normal adjacent tissues. In multiple human in vitro assay systems, a high-affinity PVRIG antagonistic monoclonal antibody (CHA.7.518.1.H4(S241P)) enhanced T cell function, in particular when combined with anti-TIGIT or anti-PD1 antibody. In addition, we report the novel characterization of mouse PVRIG using antagonistic antibodies or PVRIG deficient mice and demonstrate that inhibition of PVRIG-PVRL2 interaction reduced tumor growth, with most potent effects in combination with PD-1 inhibition or TIGIT genetic deficiency. Collectively, this data shows that PVRIG is a critical inhibitory receptor in regulating T cell anti-tumor responses and support the development of CHA.7.518.1.H4 (S241P), for clinical testing in cancer patients.

Materials and Methods

Human Peripheral Blood and Tumor Expression Studies

Healthy donor human PBMCs were obtained from Stanford University in accordance with the Declaration of Helsinki. Human tissues were provided by the Cooperative Human Tissue Network, a National Cancer Institute supported resource. Human cancer tissue and matched normal adjacent tissues were dissociated into single cells as per manufacturer's protocol (Miltenyi Biotec). Dissociated cells were analyzed by flow cytometry for expression of various targets on different cell subsets. For each target expression on an individual cell subset, a fold expression value was calculated by taking the MFI value of target divided by the MFI value of the isotype control. Other investigators may have received samples from these same tissue specimens. The tumor type was determined based on reviewing the pathology report for each sample. For IHC studies, anti-PVRL2 antibody (HPA-012759, Sigma) and PD-L1 (Sp142, SpringBio) were used to stain tumor micro-arrays (Biochain institute) using conditions as described in the supplemental methods. Scoring was performed by 2 independent reviewers on duplicate cores from the same tumor.

PVRIG Antibody Generation and Characterization

Anti-human PVRIG and anti-mouse PVRIG antibodies were generated as detailed in the supplemental methods. Briefly, antibody binding specificity and affinity were assessed by selective binding to PVRIG engineered cells with no detectable binding to cells that do no express the gene. Antagonistic activity of these anti-PVRIG antibodies was determined using ELISA and FACS based assays in which the interaction of PVRIG with PVRL2 was disrupted. For characterization in cell based assays, antibodies were tested in several T cell-target cell co-culture assay systems consisting of target cells that express PVRL2 in culture with PBMC or tumor-derived T cells. gp100 specific T cells lines were expanded from melanoma tumors as previously described (23). CMVpp65 reactive T cells were expanded from healthy donor PBMCs (CTL immunospot) with CMVpp65 (495-503), IL-2, and IL-7 for 10 days. For combination studies, antibodies to PD-1, TIGIT, and PVRIG were used at 10 µg/ml. Cytokine concentrations in conditioned media was determined using Cytometric Bead Array (CBA) and FACS staining was performed as described in the supplemental methods.

Characterization of Mouse PVRIG Expression and Function

Binding interactions of mouse PVRIG with mPVRL2 and mPVR were assessed by SPR and ELISA using recombinant PVRIG, PVRL2, and PVR proteins and by FACS using ectopically engineered PVRIG and PVRL2 overexpressing cell lines or PVR or PVRL2 siRNA transfected cell lines. PVRIG and TIGIT deficient mice were generated as described in the supplemental methods. Expression analysis was performed to examine expression of PVRIG in spleen, lymph node, and tumor in various cell subsets. Cell functional assays demonstrating a T cell modulatory activity for mouse PVRIG were established using WT and PVRIG$^{-/-}$ T cells and PVRL2 Fc or PVRL2 ectopically expressed target cells as detailed in the supplemental materials and methods. CT26, MC38, and B16/Db-hmgp100 tumor models were performed as described in the supplemental methods. All studies were approved by the Institutional Animal Care and Use committee at the Tel-Aviv University (Tel-aviv, Israel) or Johns Hopkins University (Baltimore, USA).

Results

PVRIG Expression is Highest on Effector T Cells of Peripheral Blood and Tumors

The Ig superfamily (IgSF) consists of hundreds of proteins but only a few of them are T cell inhibitory receptors. Proteins of the IgSF tend to evolve quickly (24) and therefore sequence similarity among these proteins is generally low and is not optimal for identifying novel immune receptors. To identify novel immune checkpoints, we developed bioinformatic algorithms based on shared genomic and proteomic characteristics among known immune checkpoints, such as gene structure, protein domains, predicted cellular localization and expression pattern. Using these algorithms, we identified PVRIG as a novel immune receptor. A report has recently also demonstrated that human PVRIG (CD112R) binds to PVRL2 and inhibits T cell function (15). However, the relevance of this pathway in regulating tumor immune surveillance has not been reported. Here, we have elucidated the expression and function of PVRIG and PVRL2 in human cancers and preclinical tumor models. In peripheral blood from healthy donors, PVRIG was expressed exclusively on lymphocytes, with highest expression on CD8 T cells and NK cells (FIG. 27A). Further subset analysis of T cells showed highest PVRIG expression on CD8 or CD4 memory/effector T cell subsets in comparison with Treg subset (FIG. 27B, FIG. 34A). The predominantly memory T-cell expression pattern differentiates PVRIG from other receptors in the family (TIGIT, CD96) which tend to have equal or higher expression on Tregs compared to memory/effector T cells. We further compared the expression kinetics of PVRIG and TIGIT post T cell activation in 2 assay systems (CMV recall response FIG. 27C, DC-MLR FIG. 27D, FIG. 34B) and show that PVRIG has delayed kinetics of induction and more sustained expression at the late timepoint as compared to TIGIT. The preferential expression of PVRIG on memory/effector cells as compared to TIGIT suggests a unique role for PVRIG in regulating T cell responses.

The delayed and sustained induction of PVRIG expression on T cells after activation suggested that it could be expressed in the tumor microenvironment. Next, we analyzed the expression of PVRIG on leukocytes from dissociated human tumors directly ex vivo by FACS. Expression of PVRIG was detected on CD8 T cells, CD4 T cells, and NK cells from multiple tumor types (FIG. 27E-G, Supplemental FIG. 27C). PVRIG was co-expressed with PD-1 and TIGIT on CD4 and CD8 T cells (FIG. 27F) On average, higher expression was detected on CD4$^+$ and CD8$^+$ TILs from breast, endometrial, head and neck, lung, kidney, and ovarian tumors as compared to bladder, colorectal, and prostate. In tumor samples in which PVRIG expression was low/not present ex vivo, activation with anti-CD3 and anti-CD28 enhanced the expression of PVRIG, suggesting that TIL expression of PVRIG can be further induced upon re-activation (FIG. 34D). For colon, lung, kidney, endometrial, and ovarian tumors, we were able to obtain normal adjacent tissue from the same patient and perform a comparison of PVRIG expression on lymphocytes isolated from the tumor vs normal tissue. TILS showed a significant induction of PVRIG on CD4 and CD8 T cells as compared to cells isolated from matching normal adjacent tissues (NAT) (FIG. 34E). As with PBMCs, we further compared PVRIG, TIGIT, and PD1 expression on Tregs vs CD8 T cells from lung, endometrial, and kidney tumors. On TILS, TIGIT expression was higher on Tregs compared to CD8 T cells whereas for PVRIG and PD1, similar or higher expression was observed on CD8 T cells compared to Tregs (FIG. 27E). Next, we examined the co-regulation of PVRIG, TIGIT, and PD-1 on T cell populations by correlation analysis of either the magnitude of expression on TILS ex vivo or the magnitude of the fold change in expression between tumor and NAT. In both analyses, CD4 and CD8 T cells displayed a positive and significant correlation between PVRIG and PD1 or TIGIT on (FIG. 34F). Taken together, these data demonstrate that PVRIG is expressed on T cells and NK cells from multiple human cancers, placing PVRIG as a novel inhibitory receptor target that may be critical in regulating T cell function in the tumor.

PVRL2 Expression is Enhanced in Tumors Tissue Compared to Normal Adjacent Tissue As PD-L1 expression has been demonstrated to help predict responses to PD-1 inhibitors, we examined whether the expression of PVRL2 was concomitant with expression of its cognate receptor, PVRIG, in human cancer tissues. Using a PVRL2 antibody that we validated for use in IHC (FIG. 35A), we stained tumor microarrays (TMA) composed of lung, colon, skin, breast, ovarian/endometrial, and kidney cancer tissues. With the exception of kidney, PVRL2 expression was not present or minimally expressed in the majority of normal tissues from these organs. In tumor tissues, PVRL2 was induced in a substantial number of lung, colon, skin, breast, and ovarian/endometrial cancer samples (FIG. 28A). PVRL2 expression was detected on tumor cells and immune cells at the invasive front (FIG. 28B). To determine the specific immune cell subsets expressing PVRL2, we performed flow cytometry on freshly dissociated tumors. Consistent with the IHC expression profile, expression of PVRL2 was detected on CD45$^+$ immune cells, particularly myeloid cells (e.g. CD14$^+$ tumor associated macrophages (TAMs) and myeloid DCs) and on CD45$^-$ non-immune cells from multiple tumor types (FIG. 28C, D). No expression of PVRL2 was detected on lymphocytes (data not shown). Comparison of PVRL2 expression on CD45$^-$ cells and TAMs isolated from colon, lung, kidney, endometrial, and ovarian tumors showed a significant induction of PVRL2 on cells isolated from the tumor as compared to cells isolated from matching normal adjacent tissues (NAT) of the same donor (FIG. 36D). To assess which tumors expressed both PVRIG and PVRL2, we examined expression of PVRIG on lymphocytes compared with PVRL2 on myeloid cells and on CD45$^-$ cells from multiple tumor types. Of the cancer types examined, endometrial, lung, and kidney cancers had the highest prevalence of PVRIG$^{hi}$ lymphocytes and PVRL2$^{hi}$ TAMs or CD45$^-$ non-immune cells (FIG. 28E, FIG. 37). These data demonstrate that the PVRIG-PVRL2 pathway may be particularly important in modulating the anti-tumor response by regulating the T cell—TAM interaction and the T cell-tumor cell interaction in endometrial, lung, and kidney cancers.

Compared to PD-L1, PVRL2 Expression is Differentially Regulated and Present in PD-L1-Tumors As PVRIG and PD-1 can be co-expressed on tumor-infiltrating lymphocytes (TILs), we also examined the co-expression of PVRL2 and PD-L1 on the same tumor by staining serial sections of the same TMA. All PD-L1-positive tumors also expressed PVRL2, indicating some overlap in the regulation of these 2 pathways and providing a rationale to combine a PVRIG inhibitor with PD-1/PD-L1 inhibitors (FIG. 29A). In PD-L1 negative tumors, PVRL2 was detected in a majority of these tumors across various cancer types (FIG. 29A). This suggested that PVRL2 expression was more prevalent than PD-L1 in some tumors and that targeting this pathway may be particularly effective in PD-L1-negative tumors. As PD-L1 has been reported to be induced in the tumor by IFN-γ as part of the adaptive resistance model (25), we further assessed the regulation of PVR, PVRL2 and PD-L1 expression by various inflammatory stimuli on bone marrow derived dendritic cells and on tumor epithelial cell lines (FIG. 29D). Treatment of immature BM-DCs with pro-inflammatory signals generally lead to an increase in PVR, PVRL2, and PD-L1 expression, demonstrating that PVR, PVRL2, and PD-L1 expression are both increased upon DC maturation. In contrast, treatment of epithelial cells with IFN-γ increased expression of PD-L1 but had no effect on the high baseline expression of PVRL2 (FIG. 29E). It has been reported that PVRL2 by genomic stress, DNA damage, and tumor suppressor genes (26) (27), further supporting a differential regulation of PVRL2 expression in comparison with PD-L1. In summary, these data indicate that PD-L1 and PVRL2 can be co-regulated on antigen presenting cells such as DCs but can be differentially regulated by IFN-γ on epithelial cells. The presence of PVRL2 in PD-L1-negative tumors suggests that targeting this pathway may be of potential benefit in patients that are non-responsive to PD-1 inhibitors.

CHA.7.518.1.H4(S241P) is a High Affinity Humanized Monoclonal Antibody to PVRIG that Disrupts the Interaction of PVRIG to PVRL2

To examine the functional consequences of antagonizing human PVRIG-PVRL2 interactions, we generated a high affinity, antagonistic anti-PVRIG antibody, CHA.7.518.1.H4 (S241P), which blocks the interaction of PVRIG and PVRL2. This antibody selectively bound HEK293 cells ectopically expressing human PVRIG or cynomolgus macaque PVRIG and also bound Jurkat cells that endogenously express PVRIG with sub-nanomolar affinity (FIG. 30A). In biochemical assays, CHA.7.518.1.H4(S241P) blocked the interaction of PVRIG Fc with PVRL2$^+$ HEK293 cells (FIG. 30B) and also blocked PVRL2 Fc binding to PVRIG$^+$ HEK293 cells (FIG. 30C). Using this antibody, we observed a functional effect of an antagonistic anti-PVRIG in several T cell assays. Artificial antigen-presenting cells (aAPC) ectopically expressing a cell surface anti-CD3 antibody and human PVRL2 were generated and co-cultured with primary human CD4 T cells, either in the presence of anti-PVRIG (CHA.7.518.1.H4(S241P)) or isotype control. PVRIG expression was induced on proliferating CD4 T cells upon co-culture with the CHO anti-CD3 aAPC (FIG. 38A). Antagonism of PVRIG with CHA.7.518.1.H4(S241P) enhanced proliferation of CD4 T cells from multiple donors (FIG. 30D). We also tested the effect of anti-PVRIG on 2 human gp100 reactive CD8 T cell lines that were derived from melanoma tumors. These T cell lines were individually co-cultured with aAPCs expressing HLA-A2 and PVRL2 (FIG. 38B) in the presence of isotype control IgG or anti-PVRIG antibodies. As observed in both lines, anti-PVRIG increased IFN-γ and TNF-α production by 20-50%. In a dose response assessment, CHA.7.518.1.H4(S241P) displayed single digit nano-molar EC50 values in multiple assays (FIG. 38C, D). These data collectively demonstrate that antagonizing PVRIG-PVRL2 interactions with CHA.7.518.1.H4(S241P) resulted in increased T cell activation.

CHA.7.518.1.H4(S241P) in Combination with TIGIT or PD-1 Inhibitors Resulted in Synergistic Enhancement of T Cell Function.

Combination of PVRIG and TIGIT blockade synergistically increased CD4 T cell function in a T cell-dendritic cell co-culture assay (15), suggesting a role for this pathway in regulating T cell-APC interactions. The effects of PVRIG and TIGIT blockade on CD8 T cells in a tumor cell co-culture setting has not been reported. As our tumor expression profiling demonstrated expression of PVRL2 on CD45$^-$ immune cells, we further explored the effect of targeting this pathway in T cell—tumor cell co-cultures using 2 T cell assay systems. We first performed a co-culture of 2 gp100 tumor antigen specific CD8 T cell lines with a melanoma cell line, MEL624, in the presence of anti-PVRIG, anti-TIGIT, or isotype control antibodies, either individually or in combination. MEL624 cells express both PVR and PVLR2 and both TIL-209 and TIL-463 expressed PVRIG, TIGIT, and PD-1 (FIG. 30F). On TIL-209, we observed that anti-PVRIG or anti-TIGIT alone did not increase IFN-γ and that the combination of anti-PVRIG and anti-TIGIT synergistically increased IFN-γ production (FIG. 30G). On TIL-463, we observed that anti-PVRIG or anti-TIGIT modestly increased IFN-γ production, and that combination of anti-PVRIG and anti-TIGIT additively increased IFN-γ (FIG. 30G). In an additional assay system, we utilized CMVpp65-reactive CD8 T cells as a model system to study human T cell responses. HLA-A2$^+$ CMVpp65 CD8 T cells were expanded in the presence of CMVpp65 (495-503) and expression of PVRIG, TIGIT, and PD-1 was observed on day 10 (FIG. 30F). PVRIG was expressed on CMVpp65 specific CD8 T cells at similar magnitude to what was observed in human cancer samples (FIG. 27). As target cells, we identified a PD-L1$^{hi}$ (Panc05.04) and a PD-L$^{lo}$ (Colo205) HLA-A2$^+$ cancer cell line that both expressed similar amounts of PVR and PVRL2 (FIG. 30F). We next performed a co-culture of the CMVpp65 reactive T cells with HLA-A2$^+$ tumor cell lines pulsed with pp65 (495-503) peptide in the presence of blocking antibodies to PVRIG, TIGIT, and/or PD-1. We observed that anti-PVRIG Ab increased IFN-γ by ~50% in the co-culture with Panc05.04 cells and minimally in the co-culture with Colo205 (FIG. 30H). Combination of anti-TIGIT with anti-PVRIG Ab synergistically increased IFN-γ production on both target cell lines, resulting in a greater increase in IFN-γ compared to PD-1 antibody alone (FIG. 30H). Combination of anti-PVRIG and anti-PD-1 also led to synergistic increases in IFN-γ production as compared to individual antibody (FIG. 30I). Taken together, these data suggest a potent synergy of combining PVRIG and TIGIT or PVRIG and PD1 blockade in increasing activation of human CD8 T cells upon interaction with tumor cells.

PVRIG Deficiency Resulted in Increased T Cell Proliferation and Reduced Tumor Growth Although the sequence for mouse PVRIG and its interaction with mouse PVRL2 has been reported, the expression profile and immune modulatory activity of mouse PVRIG is not well understood. We first analyzed mPVRIG RNA expression and transcript in NK, NKT and T cells (FIG. 31A). Activated mouse CD8 T cells had elevated PVRIG transcripts with delayed induction kinetics compared to TIGIT (FIG. 31B). We confirmed that that recombinant mPVRIG protein bound to mPVRL2 protein by surface plasmon resonance (SPR) and ELISA performed in several assay orientations (FIG. 39A-D). We also observed an interaction between mPVRIG and mPVR, al though the affinity was approximately 10× less than the interaction with mPVRL2 (FIG. 39E). To determine whether PVR or PVRL2 is the dominant ligand for mPVRIG, we tested the binding of mouse PVRIG Fc to B16F10 cells which express PVR and PVRL2 (data not shown). PVRIG Fc showed a dose dependent binding to B16F10 cells that was completely abolished upon PVRL2 siRNA knockdown in B16F10 cells (FIG. 39F). In comparison, the binding of PVRIG Fc fusion protein was slightly, but consistently, reduced following PVR knockdown (FIG. 39E) suggesting that a very weak interaction occurs between mPVRIG and mPVR. Taken together, these results demonstrate that in mice, PVRL2 is the primary ligand for PVRIG, as is the case in human. To delineate the role of PVRIG in immune responses, we generated PVRIG deficient (−/−) mice (FIG. 40). PVRIG$^{-/-}$ mice were born at the expected Mendelian ratios, displayed no overt phenotype up to 10 months of age, and at 8 weeks of age had similar leukocyte cellularity (peripheral and lymphoid tissue) when compared to wild type mice (FIG. 41). Wild-type (WT) CD8 T cells and NK cells express PVRIG and no expression of PVRIG was detected on PVRIG$^{-/-}$ cells (FIG. 31C). To examine the role of PVRIG in regulating mouse T cell responses, we examined the proliferation of WT and PVRIG$^{-/-}$ T cells in 2 assay systems. WT or PVRIG$^{-/-}$ T cells were activated with immobilized anti-CD3 in the presence of soluble PVRL2 Fc or control Fc protein. Soluble PVRL2 Fc significantly inhibited WT CD4$^+$ T cell proliferation but not PVRIG$^{-/-}$ CD4$^+$ T cell proliferation (FIG. 31D), suggesting that PVRIG$^{-/-}$ cells lack an inhibitory signal. To evaluate the role of mouse PVRIG in CD8$^+$ T cell interaction with tumor cells, PVRIG$^{-/-}$ mice were bred to pmel TCR transgenic mice, which express a transgenic TCR specific to gp10025-33 (28). Activated PVRIG or WT Pmel CD8+ T cells were co-cultured with B16-Db/gp100 melanoma tumor cells that endogenously express PVRL2 (data not shown) and activation and effector function evaluated. PVRIG$^{-/-}$ pmel CD8$^+$ T cells showed enhanced degranulation and production of effector cytokines (IFN-γ and TNF-α) compared to WT cells (FIG. 31E). These data indicate that mouse PVRIG inhibits activation and effector function of tumor-specific T cells upon co-culture with PVRL2$^+$ tumor target cells.

We next studied the effects of PVRIG deficiency on tumor growth in the MC38 syngeneic model. PVRIG$^{-/-}$ mice displayed significantly reduced tumor growth compared to WT mice (FIG. 32A-B). Moreover, PVRIG$^{-/-}$ mice exhibited additional anti-tumor responses following PD-L1 blockade beginning day 14, reflected in significant (p=0.052) tumor growth inhibition compared to anti-PD-L1-treated WT mice or PVRIG$^{-/-}$ mice treated with isotype control FIG. 32C,D). Consistent with the reduced tumor growth, anti-PD-L1-treated PVRIG$^{-/-}$ mice displayed a significant increase in IFN-γ$^+$TNF-α$^+$ effector CD8 T cells upon ex vivo stimulation, compared to anti-PD-L1-treated wild-type mice as well as isotype-treated PVRIG$^{-/-}$ mice (FIG. 32E). Further, anti-PD-L1-treated PVRIG$^{-/-}$ mice also had elevated numbers of effector cytokine-producing CD8$^+$ tumor-infiltrating lymphocytes (TILs), when compared to anti-PD-L1-treated wild-type mice as well as isotype-treated PVRIG$^{-/-}$ mice (FIG. 32F). Transcriptomic profiling of CD45$^+$ immune cells from tumors harvested midway through the experiment (day 18; mice received 2 doses of anti-PD-L1 or isotype control) showed that the gene signatures for TIL numbers and cytotoxic TILs were significantly enhanced in anti-PD-L1-treated PVRIG deficient mice relative to their wild-type counterparts (FIG. 32G-H). Significant changes in T cell mediated genes (GRZB, IFN-γ) was observed in the PVRIG$^{-/-}$+anti-PD-L1 group as compared to the other groups (Supplemental FIG. 42). Taken together, these data demonstrate that PVRIG deficiency, particularly when combined with PD-L1 blockade, resulted in increased T cell activation and reduced tumor growth in vivo.

Anti-mPVRIG Antibody Inhibited Tumor Growth in Combination with PD-1 Antibody or TIGIT Deficiency After demonstrating that genetic deficiency of PVRIG resulted in reduced tumor growth, we next aimed to demonstrate that antibody-mediated inhibition of PVRIG-PVRL2 interaction could improve anti-tumor immunity, in particular in combination with PD1 or TIGIT inhibitors as our human in vitro data has demonstrated. To assess this, we generated a high affinity, antagonistic anti-mPVRIG antibody. Affinity assessments of anti-mPVRIG mAb determined by FACS showed sub-nano-molar Kd (0.33 nM on HEK293 mPVRIG, 0.39 nM on D10.G4.1 cells), similar to CHA.7.518.1.H4(S241P) (FIG. 39F-G). The specificity of this antibody was further confirmed as the majority of binding to D10.G4.1 cells was abrogated upon mPVRIG knockdown (FIG. 39H). Anti-mPVRIG was tested for disrupting mPVRIG-mPVRL2 interaction by inhibiting the binding of mPVRIG Fc to B16F10 and the binding of mPVRL2 Fc to mPVRIG-overexpressing HEK293 cells (FIG. 33A). Complete blocking of PVRIG-PVRL2 interaction by anti-mPVRIG antibody was observed in both assay formats (FIG. 33A, FIG. 39I), demonstrating an antagonistic anti-mPVRIG antibody. Next, we tested the in vivo efficacy of mPVRIG blockade in a syngeneic CT26 subcutaneous colon tumor model. PVRIG expression was elevated on NK and T cells in the tumor microenvironment, compared to corresponding splenic or draining lymph node subsets (FIG. 33B). Treating tumor bearing mice with anti-mPVRIG blocking mAb as monotherapy failed to reduce tumor growth (data not shown). However, combination of anti-PVRIG and anti-PD-L1 mAbs effectively delayed CT26 tumor growth (FIG. 33C) and increased significantly the survival of treated mice with 40% rate of complete responders (FIG. 33D). Consistent with our human T cell assay data, these data demonstrate that combination of PD-1 and PVRIG inhibitors can reduce tumor growth.

We also tested the effect of ablating both PVRIG and TIGIT signaling in regulating anti-tumor responses. For these studies, we tested the efficacy of anti-mPVRIG antibody in either WT or TIGIT$^{-/-}$ mice inoculated with B16F10/Db-hmgp10 melanoma cells. Treatment of tumor bearing WT mice with anti-mPVRIG blocking mAb had minor effect compared to isotype treatment (17% TGI at day 11 and 8% TGI at endpoint, day 18). The effect of TIGIT deletion on tumor growth was minor as well, compared to WT control group (17% TGI at day 11 and 13% TGI at endpoint). However, when TIGIT deletion was combined with anti-PVRIG mAb treatment, a significant tumor growth inhibition was observed (63% at day 11 and 49% TGI at endpoint (FIG. 33E, F). In accordance to tumor growth inhibition, TIGIT$^{-/-}$ mice treated with anti-PVRIG mAb 407 exhibited increased survival compared to WT control group, however, statistical significance was not achieved in this aggressive rapidly growing tumor model (data not shown). Taken together, these data demonstrate synergistic activity of PVRIG inhibitors with PD1 or TIGIT inhibitors and are in accordance with our human functional data providing the rationale for clinical testing of CHA.7.518.1.H4(S241P) with PD1 or TIGIT inhibitors.

Discussion

Although antibodies targeting immune T cell checkpoints such as CTLA4 and PD-1 have increased cancer patient survival, the majority of cancer patients still do not display clinical benefit. One possible reason for this is the presence of additional T cell regulators that inhibit T cell anti-tumor immunity. Here, we elucidated the role of PVRIG in regulating effector T cell function and demonstrate that PVRIG antagonism increases T cell anti-tumor responses and reduces tumor growth.

PVRIG is a novel member of the nectin and nectin like family, placing it among several known immunoregulatory receptors in the family. Understanding the interplay of the receptors within this family is crucial to understanding the relevance and mechanism of action of PVRIG. Of these receptors, DNAM, TIGIT, and CD96 are most closely related to PVRIG in terms of sharing the same ligands, PVR and PVRL2. DNAM binds to both PVR and PVRL2 and delivers a costimulatory signal to lymphocytes. TIGIT is reported to bind to PVR and weakly to PVRL2. We were unable to detect an interaction between TIGIT and PVRL2 using ELISA or SPR (data not shown), suggesting that PVR is the dominant ligand for TIGIT. Using similar methods, we and a recent report detected a high affinity interaction between PVRL2 and PVRIG, suggesting that PVRIG is the dominant inhibitory receptor to PVRL2. These data suggest that TIGIT and PVRIG comprise dual signaling nodes in this axis and that blocking both is needed for maximal increase of T cell activation within this family. In addition to interacting with different ligands, we observed that PVRIG has the highest expression on effector or memory T cells, similar to PD-1 whereas TIGIT has the highest expression on regulatory T cells. Furthermore, we observed that PVRIG displayed late induction after T cell activation as compared to TIGIT. These data suggest that PVRIG has a unique role within this family, interacting with high affinity to PVRL2 and having a differentiated expression on memory cells and a late induction profile to TIGIT.

We also report here on the novel role of PVRIG in regulating anti-tumor T cell responses using PVRIG deficient mice and antagonistic anti-PVRIG antibodies. We demonstrate that mouse PVRIG was expressed on T cells and NK cells, induced upon lymphocyte activation, and is highest in the TME as compared to the periphery. Furthermore, we show that PVRIG deficiency led to increased T cell function in-vitro and reduced tumor growth in-vivo. An antagonistic antibody to PVRIG reduced tumor growth when combined with anti-PD-L1 or genetic deficiency of TIGIT, demonstrating a necessary role of PVRIG in regulating T cell responses. These novel data provide in vivo proof of concept using preclinical tumor models that targeting PVRIG in combination with PD1 or TIGIT antagonism is a potential novel therapy for the treatment of cancers.

We report here on a high affinity anti-human PVRIG antibody that disrupts the interaction of PVRIG and PVRL2 which we are pursuing for testing in clinical trials. To determine potential cancer indications that could inform on patient selection in clinical trials, we examined the expression profile of this axis in human cancers by FACS and IHC. For PVRIG, we observed that the mean expression of PVRIG on CD4 and CD8 T cells by FACS highest in endometrial, lung, kidney, and ovarian cancers, although this difference did not achieve statistical difference with other cancer types as determined by ANOVA with a Tukey's multiple comparison test with the current number of samples. As PVRIG is induced upon T cell activation and given that the majority of tumor infiltrating T cells are antigen experienced, it is perhaps not surprising that the median PVRIG expression was similar across tumor samples and cancer types. We observed that PVRIG expression was correlated with PD-1 and TIGIT expression, suggesting that the interplay of these 3 inhibitory receptors will be important in regulating the anti-tumor response. In this report, we observed a synergistic increase in T cell function when PVRIG antibodies were combined with TIGIT antibodies in a CD8 T cell tumor cell co-culture, better than PD-1 in combination with PVRIG or TIGIT inhibitors. These data, along with a previous study demonstrating a role for PVRIG and TIGIT in regulating DC-T cell interactions, show that this pathway could be involved in regulating T cell-APC and T cell-tumor cell interactions, and provide multiple mechanisms by which targeting PVRIG could increase the anti-tumor immune response.

As expression of PD-L1 has been correlated with clinical response to PD-1 inhibitors, we also analyzed PVRL2 expression in tumors by FACS and IHC to assess whether certain cancer types have higher expression. Assessing dissociated tumor cells, we observed that mean PVRL2 expression on macrophages from endometrial, head & neck, kidney, lung, and ovarian samples were higher when compared to other tumor types. Mean PVRL2 expression on $CD45^-$ non immune cells was higher on breast, colorectal, endometrial, lung, ovarian, and prostate cancers compared to other cancers. Based on the PVRIG and PVRL2 expression, we determined that endometrial, head & neck, lung, kidney, and ovarian cancers have a greater incidence of tumors with high PVRIG and PVRL2 expression and that these are potential cancers that could response to inhibitors of this pathway.

We did observe that PVRL2 expression can be modulated on antigen producing cells in vitro by inflammatory mediators whereas PVRL2 expression on cancer cells was not altered. These data suggest that PVRL2 expression on antigen presenting cells can be regulated by inflammation and could be an indicator of an inflamed tumor. Indeed, we did observe that all PD-L1+ tumors also express PVRL2, both on the tumor cells and in the immune compartment. Expression of PVRL2 on myeloid cells could help predict responses to PVRIG inhibitors in a combination setting with PD-1 or TIGIT to further enhance the anti-tumor effect. Interestingly, a portion of PD-L1 negative tumors also expressed PVRL2, primarily on the tumor cells and not on the immune cells. PVR and PVRL2 expression on epithelial cells is reported to be induced in tumorigenesis by xyz and also in response to stress and DNA damage. These data are consistent with our in vitro finding that the regulation of PVRL2 expression on tumor cells is not dependent on IFN-γ. As PD-L1 is induced in an adaptive resistance setting in response to IFN-γ and is associated with an inflammatory response, the expression of PVRL2 in the absence of PD-L1 suggests that PVRL2 expression is more prevalent than PD-L1 and that PVRL2 is expressed in non-inflamed tumors. Based on the above, it is possible that the presence of PVR and PVRL2 contribute to suppressing immune responses independently of PD-L1 and that inhibitors of PVRIG and TIGIT could be of particular importance in patients that are PD-L1 negative or non-responders/progressors to PD-1 inhibitors.

In summary, this report provides several novel insights into PVRIG biology, including characterizing the expression of this axis in human cancers, demonstrating a prominent role for PVRIG/TIGIT in regulating the CD8-tumor cell interaction, and showing that PVRIG antagonism in combination with PD-1 inhibition or TIGIT deficiency lead to a synergistic reduction in tumor growth. These data extend our current understanding of PVRIG biology and provide rationale for clinical testing of CHA.7.518.1.H4(S241P), a high affinity anti-PVRIG antibody, in patients with cancer.

REFERENCES

1. Hanahan D, Weinberg R A. The hallmarks of cancer. Cell 2000; 100(1):57-70.
2. Hanahan D, Weinberg R A. Hallmarks of cancer: the next generation. Cell 2011; 144(5):646-74 doi 10.1016/j.cell.2011.02.013.
3. Galon J, Mlecnik B, Bindea G, Angell H K, Berger A, Lagorce C, et al. Towards the introduction of the 'Immunoscore' in the classification of malignant tumours. J Pathol 2014; 232(2):199-209 doi 10.1002/path.4287.
4. Zitvogel L, Galluzzi L, Smyth M J, Kroemer G. Mechanism of action of conventional and targeted anticancer therapies: reinstating immunosurveillance. Immunity 2013; 39(1):74-88 doi 10.1016/j.immuni.2013.06.014.
5. Danilova L, Wang H, Sunshine J, Kaunitz G J, Cottrell T R, Xu H, et al. Association of PD-1/PD-L axis expression with cytolytic activity, mutational load, and prognosis in melanoma and other solid tumors. Proc Natl Acad Sci USA 2016; 113(48):E7769-E77 doi 10.1073/pnas.1607836113.
6. Topalian S L, Taube J M, Anders R A, Pardoll D M. Mechanism-driven biomarkers to guide immune checkpoint blockade in cancer therapy. Nat Rev Cancer 2016; 16(5):275-87 doi 10.1038/nrc.2016.36.
7. Zarour H M. Reversing T-cell Dysfunction and Exhaustion in Cancer. Clin Cancer Res 2016; 22(8):1856-64 doi 10.1158/1078-0432.CCR-15-1849.
8. Pardoll D M. The blockade of immune checkpoints in cancer immunotherapy. Nat Rev Cancer 2012; 12(4):252-64 doi 10.1038/nrc3239.
9. Sharma P, Allison J P. Immune checkpoint targeting in cancer therapy: toward combination strategies with curative potential. Cell 2015; 161(2):205-14 doi 10.1016/j.cell.2015.03.030.
10. Cha E, Klinger M, Hou Y, Cummings C, Ribas A, Faham M, et al. Improved survival with T cell clonotype stability after anti-CTLA-4 treatment in cancer patients. Sci Transl Med 2014; 6(238):238ra70 doi 10.1126/scitranslmed.3008211.
11. Robert L, Tsoi J, Wang X, Emerson R, Homet B, Chodon T, et al. CTLA4 blockade broadens the peripheral T-cell receptor repertoire. Clin Cancer Res 2014; 20(9):2424-32 doi 10.1158/1078-0432.CCR-13-2648.
12. Tumeh P C, Harview C L, Yearley J H, Shintaku I P, Taylor E J, Robert L, et al. PD-1 blockade induces responses by inhibiting adaptive immune resistance. Nature 2014; 515(7528):568-71 doi 10.1038/nature13954.
13. Chan C J, Andrews D M, Smyth M J. Receptors that interact with nectin and nectin-like proteins in the immunosurveillance and immunotherapy of cancer. Curr Opin Immunol 2012; 24(2):246-51 doi 10.1016/j.coi.2012.01.009.
14. Martinet L, Smyth M J. Balancing natural killer cell activation through paired receptors. Nat Rev Immunol 2015; 15(4):243-54 doi 10.1038/nri3799.
15. Zhu Y, Paniccia A, Schulick A C, Chen W, Koenig M R, Byers J T, et al. Identification of CD112R as a novel checkpoint for human T cells. J Exp Med 2016; 213(2):167-76 doi 10.1084/jem.20150785.
16. Bottino C, Castriconi R, Pende D, Rivera P, Nanni M, Carnemolla B, et al. Identification of PVR (CD155) and Nectin-2 (CD112) as cell surface ligands for the human DNAM-1 (CD226) activating molecule. J Exp Med 2003; 198(4):557-67 doi 10.1084/jem.20030788.
17. Yu X, Harden K, Gonzalez L C, Francesco M, Chiang E, Irving B, et al. The surface protein TIGIT suppresses T cell activation by promoting the generation of mature immunoregulatory dendritic cells. Nat Immunol 2009; 10(1):48-57 doi 10.1038/ni.1674.
18. Stanietsky N, Simic H, Arapovic J, Toporik A, Levy O, Novik A, et al. The interaction of TIGIT with PVR and PVRL2 inhibits human NK cell cytotoxicity. Proc Natl Acad Sci USA 2009; 106(42):17858-63 doi 10.1073/pnas.0903474106.
19. Johnston R J, Comps-Agrar L, Hackney J, Yu X, Huseni M, Yang Y, et al. The immunoreceptor TIGIT regulates antitumor and antiviral CD8(+) T cell effector function. Cancer Cell 2014; 26(6):923-37 doi 10.1016/j.ccell.2014.10.018.
20. Zhang B, Zhao W, Li H, Chen Y, Tian H, Li L, et al. Immunoreceptor TIGIT inhibits the cytotoxicity of human cytokine-induced killer cells by interacting with CD155. Cancer Immunol Immunother 2016; 65(3):305-14 doi 10.1007/s00262-016-1799-4.
21. Chan C J, Martinet L, Gilfillan S, Souza-Fonseca-Guimaraes F, Chow M T, Town L, et al. The receptors CD96 and CD226 oppose each other in the regulation of natural killer cell functions. Nat Immunol 2014; 15(5):431-8 doi 10.1038/ni.2850.
22. Fuchs A, Cella M, Giurisato E, Shaw A S, Colonna M. Cutting edge: CD96 (tactile) promotes N K cell-target cell adhesion by interacting with the poliovirus receptor (CD155). J Immunol 2004; 172(7):3994-8.
23. Machlenkin A, Uzana R, Frankenburg S, Eisenberg G, Eisenbach L, Pitcovski J, et al. Capture of tumor cell membranes by trogocytosis facilitates detection and isolation of tumor-specific functional CTLs. Cancer Res 2008; 68(6):2006-13 doi 10.1158/0008-5472.CAN-07-3119.
24. Ohtani H, Nakajima T, Akari H, Ishida T, Kimura A. Molecular evolution of immunoglobulin superfamily genes in primates. Immunogenetics 2011; 63(7):417-28 doi 10.1007/s00251-011-0519-7.
25. Taube J M, Anders R A, Young G D, Xu H, Sharma R, McMiller T L, et al. Colocalization of inflammatory response with B7-hl expression in human melanocytic lesions supports an adaptive resistance mechanism of immune escape. Sci Transl Med 2012; 4(127):127ra37 doi 10.1126/scitranslmed.3003689.
26. Cerboni C, Fionda C, Soriani A, Zingoni A, Doria M, Cippitelli M, et al. The DNA Damage Response: A Common Pathway in the Regulation of NKG2D and DNAM-1 Ligand Expression in Normal, Infected, and Cancer Cells. Front Immunol 2014; 4:508 doi 10.3389/fimmu.2013.00508.
27. de Andrade L F, Smyth M J, Martinet L. DNAM-1 control of natural killer cells functions through nectin and nectin-like proteins. Immunol Cell Biol 2014; 92(3):237-44 doi 10.1038/icb.2013.95.
28. Overwijk W W, Tsung A, Irvine K R, Parkhurst M R, Goletz T J, Tsung K, et al. gp100/pmel 17 is a murine tumor rejection antigen: induction of "self"-reactive, tumoricidal T cells using high-affinity, altered peptide ligand. J Exp Med 1998; 188(2):277-86.

Example 6: Tumor Cell Killing Assay

The effect of an anti-human TIGIT antibody and CHA.7.518.1.H4(S241P), either alone or in combination, on tumor cell killing was assessed by an in vitro co-culture assay with human CMV-specific CD8$^+$ T cells. The HLA-A2$^+$ target cell lines used in the assay were the melanoma cell line, Mel624, which stably expresses human PVR and PVRL2, and the pancreatic adenocarcinoma cell line, Panc05.04, which expresses endogenous levels of human PVR and PVRL2. Both tumor cell lines were stably transduced with a luciferase reporter gene through lentiviral transduction (System Biosciences). Mel624 and Panc05.04 cells were pulsed with the CMV pp65 peptide at 0.0033 µg/ml or 0.01 µg/ml at 37° C. for 1 hour, respectively. Cells were then washed and plated at 20,000 cells/well. A benchmark anti-human TIGIT antibody and CHA.7.518.1.H4 (S241P) were added to the culture in combination, or with a control hIgG4 isotype antibody at 10 µg/ml. Human CMV-specific CD8$^+$ T cells from three different donors, specified as Donor 4, Donor 72, and Donor 234 were added at 100,000 cells/well. Co-cultures were incubated at 37° C. for 16 hours. After the incubation, plates were removed from the incubator and allowed to equilibrate to room temperature for 30 minutes. Bio-Glo luciferase substrate (Promega) was added to each well and the mixture equilibrated for 10 minutes at room temperature protected from light. Luminesce or relative light units (RLU) was quantified on an EnVision multi-label reader (Perkin Elmer) with an ultrasensitive luminescence detector. Percent specific killing was calculated by [(RLU for treatment antibody−RLU for medium alone)/RLU for medium alone]×100.

Results

FIGS. 43A and B show the effect of the anti-TIGIT antibody and CHA.7.518.1.H4(S241P) treatment on killing of the Mel624 and Panc05.04 cells, respectively. When added to the co-culture alone, both the anti-TIGIT antibody and CHA.7.518.1.H4(S241P) induced significant T cell killing of the tumor cell lines compared to the isotype control antibody. For the anti-TIGIT antibody the percent specific killing ranged from 19-41% for the Mel624 cells, and 3-44% for the Panc05.04 cells across the 3 different CMV-reactive donors tested. For CHA.7.518.1.H4(S241P), the percent specific killing ranged from 16-20% for the Mel624 cells, and 0.21-29% for the Panc05.04 cells. In some cases, an additive effect on tumor cell killing was observed in the combined treatment of the anti-TIGIT antibody and CHA.7.518.1.H4(S241P).

To determine whether the effect of an anti-TIGIT antibody and CHA.7.518.1.H4(S241P) on tumor cell killing was dose-dependent, the assay was carried out with a 10 point, 2-fold dilution series for each antibody starting at 0.5 µg/ml for the anti-TIGIT antibodies, and 10 µg/ml for CHA.7.518.1.H4(S241P) (FIG. 44). Mel624 killing decreased in a dose-dependent manner when either anti-TIGIT antibody, BM26 or CPA.9.086, were combined with CHA.7.518.1.H4(S241P). More potent killing was observed for the CPA.9.086 and CHA.7.518.1.H4(S241P) combination with an EC$_{50}$ of 0.40±0.49 nM, compared to the BM26 and CHA.7.518.1.H4(S241P) combination with an EC$_{50}$ of 2.6±1.7 nM.

Example 7: Biophysical Measurement of KD

KinExA equilibrium experiments were performed using a KinExA 3200 instrument (Sapidyne Instruments, Boise, Id., USA) at 22° C. Recombinant His-tagged human TIGIT was obtained from Sino Biologicals (Beijing, China) and reconstituted into 1×PBS. All antigen and antibody samples for KinExA analyses were prepared in degassed PBST buffer (PBS with 0.05% tween 20) with 100 µg/mL filtered BSA and 0.02% sodium azide. The secondary detection antibody used was Alexa Flour 647-labeled goat anti-human IgG (H+L) (Jackson ImmunoResearch Laboratories) diluted 400- to 700-fold in the PBST buffer (with BSA and azide) described above from a 0.5 mg/mL stock in 1×PBS, pH 7.4. For each KinExA experiment, ~20 µg of human TIGIT was diluted into 1 mL of 50 mM sodium carbonate, pH 9.2 which was added directly to 50 mg of azlactone beads (Ultralink Support, Thermo Scientific, Rockford, Ill., USA) and rocked overnight at 4° C. After rocking, the beads were rinsed once with 1 M Tris buffer, pH 8.5, containing 10 mg/mL BSA and rocked for one hour at room temperature in the same buffer. Coupled beads were added to the bead reservoir in the KinExA instrument and diluted to ~30 mL with 1×HBS-N (0.01 M Hepes, 0.15M NaCl, GE Healthcare) containing 0.02% sodium azide which was also the running buffer for the KinExA instrument. All antigen-coupled beads were used immediately after preparation.

For two replicate measurements of K$_D$ for CPA.9.086 (Table 1), 14 concentrations of TIGIT ranging from 957 aM-212 pM were equilibrated at room temperature for ~72 hours with 2.5 pM CPA.9.086 binding sites and 1.8 pM CPA.9.086 binding sites. For CPA.9.083, 14 concentrations of TIGIT ranging from 478 aM-196 pM were equilibrated for ~72 hours with 1.8 pM CPA.9.083 binding sites. For duplicate measurements of the benchmark antibody, BM26 hIgG4, 14 concentrations of TIGIT ranging from 9.6 fM-3.53 nM were equilibrated for ~72 hours with 20 pM BM26 binding sites and 8.0 pM BM26 binding sites. For CHA.9.547.13, 14 concentrations of TIGIT ranging from 10.5 fM-2.2 nM were equilibrated for ~72 hours with 8 pM mAb CHA.9.547.13 binding sites. The volume flowed through the bead pack for each equilibrated sample for all experiments ranged from 4 mL to 11 mL at a flow rate of 0.25 mL/min. Data were fit with a 1:1 "standard equilibrium" binding model using KinExA Pro software (Version 4.2.10; Sapidyne Instruments) to estimate $K_D$ and generate the 95% confidence interval (CI) of the curve fit.

Results

Both CPA.9.083 and CPA.9.086 bound to human TIGIT with femtomolar binding affinity, while CHA.9.547.13 and BM26 bound with picmolar affinity. Thus, CPA.9.083 and CPA.9.086 bound to human TIGIT with the highest affinity of the four different antibodies tested.

TABLE 1

$K_D$ measurements of anti-human TIGIT hIgG4 antibodies determined by KinExA

| Antibody | $K_D$ ± 95% CI (n = 1) | $K_D$ ± 95% CI (n = 2) |
| --- | --- | --- |
| CHA.9.547.13 | 18.8 ± 5.8 pM | Not determined |
| CPA.9.083 | 694 ± 277 fM | Not determined |
| CPA.9.086 | 553 ± 230 fM | 665 ± 378 fM |
| BM26 | 8.2 ± 2.8 pM | 11.2 ± 3.6 pM |

Example 8: Development and Functional Characterization of CPA.9.086, a Novel Therapeutic Antibody Targeting the Immune Checkpoint Tigit Background: TIGIT is a coinhibitory receptor that is highly expressed on lymphocytes, including effector and regulatory CD4+ T cells (Tregs), effector CD8+ T cells, and NK cells, that infiltrate different types of tumors. Engagement of TIGIT with its reported ligands, poliovirus receptor (PVR) and PVR-like proteins (PVRL2 and PVRL3) directly suppresses lymphocyte activation. PVR is also broadly expressed in tumors, suggesting that the TIGIT-PVR signaling axis may be a dominant immune escape mechanism for cancer. We report here the biophysical and functional characterization of CPA.9.086, a therapeutic antibody targeting TIGIT. We also demonstrate that co-blockade of TIGIT and a new checkpoint inhibitor, PVRIG, augments T cell responses.

Materials and Methods: Human phage display and mouse hybridoma antibody discovery campaigns were conducted to generate therapeutic anti-TIGIT antibodies. The resulting antibodies were evaluated for their ability to bind to recombinant and cell surface-expressed human TIGIT with high affinity. Cross-reactivity of the antibodies to cynomolgus macaque and mouse TIGIT was also examined. A subset of antibodies that bound with high affinity to human TIGIT, and cross-reactive to cynomolgus TIGIT were further characterized for their ability to block the interaction between TIGIT and PVR. Blocking antibodies were screened for their ability to enhance antigen-specific T cell activation in vitro either alone, or in combination with an anti-PVRIG antibody, CHA.7.518.1.H4(S241P).

Results:

We identified a lead antibody, CPA.9.086, that binds to human TIGIT with high femtomolar affinity. This antibody bound to TIGIT endogenously expressed on human CD8+ T cells with higher affinity than tested benchmark antibodies, and was also cross-reactive to both cynomolgus and mouse TIGIT. When tested for in vitro activity, CPA.9.086 augmented cytokine secretion and tumor cell killing by CMV-specific CD8+ T cells with superior or equivalent potency to the tested benchmark antibodies. Combination of CPA.9.086 with an anti-PD1 antibody or CHA.7.518.1.H4(S241P) resulted in enhanced CMV-specific CD8+ T cell activity. Furthermore, we demonstrated that TIGIT is predominantly expressed on Tregs and effector CD8+ T cells from solid tumors compared to peripheral blood, suggesting that these populations will likely be preferentially targeted by CPA.9.086.

Conclusion:

We describe the development of a very high affinity antagonistic TIGIT antibody, CPA.9.086, that is currently in preclinical development. We postulate that the femtomolar affinity of CPA.9.086 could result in lower and less frequent dosing in patients. CPA.9.086 can enhance human T cell activation either alone or in combination with other checkpoint antibodies. Thus, our data demonstrates the utility of targeting TIGIT, PD1, and PVRIG for the treatment of cancer.

Example 9: Analysis of the TIGIT/PVRIG Axis in Human Cancers to Support Indication Selection and Biomarkers for Co-Treatment Background:

PVRIG and TIGIT were identified by Compugen's Predictive Discovery Platform as immune inhibitory receptors and have been reported to inhibit anti-tumor activity. We are pursuing clinical development of antagonistic antibodies to PVRIG (e.g. CHA7.518.1.H4(S241P)) and to TIGIT (e.g. CPA.9.083.H4(S241P)). Here, we analyzed primary human cancer tissues and immune cells to characterize expression in the TIGIT/PVRIG axis to support indication selection and combination strategies for these antibodies.

Methods:

CHA7.518.1.H4(S241P) and CPA.9.083.H4(S241P) were identified based on ability to block the interaction of PVRIG and TIGIT with their cognate ligands (PVRL2 and PVR respectively) and were screened for their ability to enhance antigen-specific CD8 T cell activation in a co-culture with tumor cell lines. Immunohistochemistry and Flow cytometry were performed to assess receptor/ligand expression in dissociated bladder, breast, colorectal, head and neck, lung, kidney, ovarian, prostate, and stomach tumors.

Results:

Among the cancers examined, PVRIG and PVRL2 expression was highest in endometrial, lung, kidney, ovarian, and head and neck cancers compared to normal adjacent tissue. From dissociated tumors, PVRIG expression was detected on T and NK TILs whereas PVRL2 expression was detected on CD45− cells and myeloid cells. A co-expression analysis of PVRIG, TIGIT, and PD1 demonstrated that PVRIG was co-expressed with both TIGIT and PD1 and that PVRIG+TIGIT+PD1+ cells comprised a major proportion of CD8 TILs. In comparison to PD-L1, PVRL2 expression was more prevalent across several cancer types and expression of PVRL2 was detected in PD-L1 negative samples. In vitro, combination of CHA7.518.1.H4(S241P) with PD1 inhibitors or CPA.9.083.H4(S241P) enhanced CD8 cytokine production and cytotoxic activity, with the triple combination of CHA7.518.1.H4(S241P), CPA.9.083.H4(S241P), and PD-1 antibody yielding the greatest increase in functional activity. Several immune receptors were induced in response of PVRIG blockade by CHA7.518.1.H4(S241P) on CD8 T cells. Taken together, these data support indication selection and combination strategies for CHA7.518.1.H4(S241P) and CPA.9.083.H4(S241P) and potential biomarkers that could be indicators of response.

Conclusions:

In summary, we demonstrate that PVRIG and PVRL2 are induced in the tumor microenvironment of human cancers, and the potential of CHA7.518.1.H4(S241P) as a cancer therapeutic, either as a monotherapy or as a dual- or triple-combination therapy with antibodies targeting TIGIT, and PD-1. These data highlight the potential of this combination approach to expand the immune checkpoint inhibitor responsive cancer patient population, including those who are non-responsive to PD-1 inhibitors.

Example 10: PVRIG Expression is Associated with T Cell Exhaustion and Synergizes with TIGIT to Inhibit Anti-Tumor Responses Abstract By employing a unique computational discovery platform, we identified a novel checkpoint receptor family comprised of 2 inhibitory receptors in the nectin family, TIGIT and PVRIG. PVRIG and TIGIT are both expressed upon T cell activation, but display a difference in relative expression among T cell subsets and expression kinetics. PVRIG binds to PVRL2 whereas TIGIT binds to several ligands, among which we observed that PVR is the dominant functional ligand for TIGIT. The distinct expression profile of PVRIG and a unique high affinity PVRIG-PVRL2 interaction suggest that PVRIG has a unique role in regulating immunity. Using novel PVRIG–/– mice, we observed that genetic deficiency of PVRIG resulted in increased T cell responses and reduced tumor growth in preclinical models, demonstrating the potential of targeting this pathway in cancer. To further define a clinical niche for a PVRIG antagonist, we interrogated the expression of TIGIT/PVRIG and PD-1 axis in human tumor samples. Among the human cancers examined, PVRIG and TIGIT expression on tumor derived T cells were highest in endometrial, lung, kidney, and ovarian cancers. A co-expression analysis of PVRIG, TIGIT, and PD1 demonstrated that PVRIG was correlated and co-expressed with both TIGIT and PD1 and that PVRIG$^+$TIGIT$^+$PD1$^+$ cells comprised a major percentage of CD8 tumor infiltrating lymphocytes (TILs). Interestingly, PVRIG and not TIGIT expression on CD8$^+$ TILs were associated with an exhausted Eomes$^{hi}$T-bet$^{lo}$ phenotype. PVR, PVRL2, and PD-L1 also displayed tissue specific differences in relative expression level, with endometrial and ovarian tumors having a higher ratio of PVRL2 expression relative to PVR or PD-L1. Culture of primary human TILs with anti-PVRIG (CHA7.518.1.H4(S241P)) and anti-TIGIT (CPA.9.083.H4(S241P)) antagonistic antibodies enhanced T cell function to a similar or greater magnitude compared to PD-1 blockade. See, FIGS. 54 through 60. CHA7.518.1.H4(S241P) & CPA.9.083.H4(S241P) Target Pvrig and Tigit in the Nectin & Nectin-Like Family: Conclusions PVRIG and TIGIT are non-redundant checkpoint receptors and promising targets for the treatment of cancer In tumors with higher PVRL2 than PVR, the PVRIG/PVRL2 interaction could be more dominant and require direct targeting of PVRIG Example 11: New Preclinical Data Demonstrating the Distinctive Features of the PVRIG Pathway in Immuno-Oncology and the Potential of CHA7.518.1.H4(S241P) in Treating Multiple Solid Tumors Data Further Strengthens Rationale for Clinical Development Plan and Biomarker Strategy for CHA7.518.1.H4 (S241P)

CHA7.518.1.H4(S241P) Shown to be Safe at High Doses in GLP Toxicity Study

Provides new preclinical data demonstrating the distinctive features of the PVRIG pathway in Immuno-Oncology and the potential of CHA7.518.1.H4(S241P), a first-in-class therapeutic antibody candidate targeting PVRIG in treating multiple solid tumors. The data, presented at the Keystone Symposia Conference, A3: T Cell Dysfunction, Cancer and Infection, being held Jan. 16-20, 2018 (an provided in Example 9 and related figures), demonstrate the possible dominance of the PVRIG/TIGIT axis in immuno-oncology and support the Company's clinical development program and biomarker strategy for CHA7.518.1.H4(S241P) as a monotherapy and in combination with CPA.9.083.H4 (S241P).

The poster titled "PVRIG Expression is Associated with T Cell Exhaustion and Synergizes with TIGIT to Inhibit Anti-Tumor Responses" (Poster no. 2028) includes data showing that expression of PVRL2, the ligand for PVRIG, is more dominant in several tumor types including lung, breast, endometrial, and ovarian, than the expression of PVR, the ligand for TIGIT. These results suggest that PVRIG may be the dominant checkpoint in patient populations with tumor expressing elevated PVRL2, many of which are not responsive to PD-1 inhibitors. Therefore, these patients may have an increased likelihood of responding to CHA7.518.1.H4(S241P) as a monotherapy treatment.

In addition, expression studies show that PVRIG and TIGIT and their respective ligands are commonly expressed in the tumor types listed above as well as kidney and head & neck cancers, indicating that in patient populations where the two pathways are operative the blockade of both TIGIT and PVRIG may be needed in order to sufficiently stimulate the anti-tumor immune response. Furthermore, data also indicates that exhausted TILs found in multiple tumor types are largely co-expressing the triple three checkpoints, TIGIT, PD-1 and PVRIG, further supporting the relevance of a triple combination in such patient populations.

Our growing understanding of the PVRIG-TIGIT axis and the interplay between the various axis components also shed light on the evolution of the PVRIG/PVRL2 pathway in the transition from mouse to humans, resulting in a less active pathway in mice. Our data clearly demonstrates that the mouse biology in connection of this pathway is underestimating the human impact this pathway may have on anti-tumor immunity, suggesting that CHA7.518.1.H4(S241P) may have an even greater therapeutic impact than the one seen in preclinical studies.

"The potential dominance of the PVRIG pathway and its interactions with the TIGIT and PD-1 pathways demonstrated in our preclinical studies coupled with the expression profiles provide the biological rationale to support our clinical approach to test CHA7.518.1.H4(S241P) as a monotherapy and in dual and triple combination as we are preparing to initiate our clinical Phase 1b trial. While keeping our all corners trial design, our biomarker strategy will be driven by these expression profiles, in order to enrich for patients most likely to respond to CHA7.518.1.H4 (S241P)," stated Anat Cohen-Dayag, PhD, President and CEO of Compugen. "We are also encouraged by results of the GLP toxicity study for CHA7.518.1.H4(S241P), showing it to be safe at high doses. Our data lead us to believe that the PVRIG pathway and CHA7.518.1.H4(S241P), our first-in-class therapeutic antibody, may hold significant clinical value as the basis of new cancer immunotherapies to meet the needs of patient populations non-responsive or refractory to current immune checkpoint inhibitor therapy."

About CHA7.518.1.H4(S241P) and CPA.9.083.H4(S241P)

CHA7.518.1.H4(S241P) is a humanized hybridoma antibody that binds with high affinity to PVRIG, a novel B7/CD28-like immune checkpoint target candidate discovered by Compugen, indicating blockage of this target's interaction with PVRL2. Blockade of PVRIG by CHA7.518.1.H4(S241P) has demonstrated potent, reproducible enhancement of T cell activation, consistent with the desired mechanism of action of activating T cells in the tumor microenvironment to generate anti-tumor immune responses. In addition, CHA7.518.1.H4(S241P) combined with antagonist anti-PD-1 antibodies has demonstrated synergistic effect on human T cell stimulation, indicating the potential of these combinations to further enhance immune response against tumors.

CPA.9.083.H4(S241P), Compugen's antibody targeting TIGIT, was developed for combination use with CHA7.518.1.H4(S241P). Preclinical data strongly support the dual blockade of the two negative costimulatory arms of the axis—TIGIT and PVRIG—that results in a more robust T cell response to antigen stimulation, and therefore may result in an enhanced anti-tumor immune response.

Example 12: In Vivo Efficacy and Survival with Triple Combo Treatment

Rationale and Objectives

This example provides regarding whether the combination of mouse TIGIT, PVRIG and PD-L1 blockade can significantly enhance tumor growth inhibition (TGI) and survival in a syngeneic mouse tumor model.

Protocols

Animals

Female mice of 5 week-age were purchased from Charles River Laboratories. The mice were housed at the Compugen USA animal facility with food and water provided, ad libitum, and acclimated for a minimum of 6 days prior to initiation of the study. All studies were approved by the Institutional Animal Care and Use Committee at the Compugen USA (South San Francisco, Calif.).

Syngeneic Mouse Tumor Model $5 \times 10^5$ CT26 colon carcinoma (ATCC) cells were inoculated subcutaneously (s.c.) into the right flank of female Balb/c mice, and grown for up to 8 days. Mice with tumors measuring 30-60 mm$^3$ were randomized (day of randomization designated day 0) into 3 groups of 10 mice per group. Animals received a 200 μL intraperitoneal (i.p.) injection of either a mouse IgG1 (mIgG1) isotype control antibody (referred to as Synagis), a dual combination of an anti-TIGIT mIgG1 and anti-PVRIG mIgG1 antibodies, or a triple combination of anti-TIGIT mIgG1, anti-PVRIG mIgG1, and anti-PD-L1 mIgG1 antibodies. The anti-TIGIT mIgG1 antibody is a chimeric version of CPA.9.086 that contains the human variable heavy and light chains of CPA.9.086 and the constant region of mIgG1. The antibodies were administered at fixed-doses of 10 mg/kg anti-TIGIT, 10 mg/kg anti-PVRIG, and a suboptimal dose of anti-PD-L1 at 3 mg/kg starting on day 8 three times per week for 2 weeks. Tumor growth is determined by caliper measurement of length (L) and width (W); wherein the tumor size is calculated with the formula $(L \times W^2)/2$. Tumor size were not allowed to exceed 2000 mm$^3$, which was designated as the study endpoint, and mice were subsequently euthanized.

Statistical Analysis

Two-way ANOVA with repeated measures, followed by two-way ANOVA with repeated measures for selected pairs of groups was performed using prism software. Analyses of tumor growth measurements were performed by comparing tumor volumes measured on the last day on which all study animals were alive. Statistical differences in percentage of mice tumor free were determined by a Log Rank Mantel-Cox test.

Results and Summary

In this study, the effect of blocking three different immune checkpoint pathways, TIGIT, PVRIG and PD-L1, on TGI and survival in mice was examined. Using the mouse colon carcinoma CT26 model, the combination of the anti-TIGIT mIgG1 with the anti-PVRIG mIgG1 resulted in small but significant TGI (20.7% TGI at day 25) compared to the mice dosed with the isotype control antibody. When the three antibodies were combined, TGI increased to 58.3% at day 25, which was statistically and significantly efficacious compared to the dual combination ($p<0.001$ by two-way ANOVA at day 25). Although none of the mice were tumor free (CR) by the end of the study (day 28), the enhanced efficacy in triple combination was associated with increased survival compared to dual combination. Triple blockade demonstrated significant enhancement of overall survival with 90% survival at the study endpoint (day 28). In addition to the antitumor efficacy reported here, there was no significant body weight changes in all groups observed (data not shown). Taken together, the triple combination was well tolerated and produced a superior antitumor effect in colon carcinoma in vivo compared to the dual combination of TIGIT and PVRIG blockade alone. See, FIG. 61.

SEQUENCE LISTING (1855 sequences)

SEQ ID NO: 1 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 6 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 7 - protein, 327 aa, Artificial Sequence
  source: /note="Description of Artificial Sequence: Synthetic polypeptide"
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 8 - protein, 107 aa, Homo sapiens [sequence omitted]

SEQ ID NO: 9 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 10 - protein, 120 aa, Homo sapiens
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 11 - protein, 121 aa, Macaca fascicularis
MMTGTIETTGNISAKKGGSVILQCHLSSTMAQVTQVNWEQHDHSLLAIRNAELGWHIYPAFKDRVAPGPGLGLTLQSLTMNDTGEYFCTYHTYPDGTYRGRIFLEVLESSVAEHSARFQIP

SEQ ID NO: 12 - protein, 131 aa, Homo sapiens
TPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRAD

SEQ ID NO: 13 - protein, 131 aa, Macaca fascicularis
TPEVWVQVQMEATELSSFTVHCGFLGPGSISLVTVSWGGPDGAGGTKLAVLHPELGTRQWAPARQARWETQSSISLALEDSGASSPFANTTFCCKFASFPEGSWESCGSLPPSSDPGLSAPPTPVPILRAD

SEQ ID NO: 14 - protein, 150 aa, Homo sapiens [sequence omitted]

SEQ ID NO: 15 - protein, 150 aa, Macaca fascicularis
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 16 - protein, 121 aa, Artificial Sequence
  source: /note="Description of Artificial Sequence: Synthetic polypeptide"
QVQLVESGGGLVQPGGSLRLSCAASGFTFSSYGMHWVRQAPGKGLEWVAFIRYDGSNKYYADSVKGRFTISRDNSKNTLYLQMNSLRAEDTAVYYCAKEMLVQDYYYMDVWGQGTTVTVSS

SEQ ID NO: 17 - protein, 8 aa, Artificial Sequence
  source: /note="Description of Artificial Sequence: Synthetic peptide"
GFTFSSYG

SEQ ID NO: 18 - protein, 8 aa, Artificial Sequence
  source: /note="Description of Artificial Sequence: Synthetic peptide"
IRYDGSNK

SEQ ID NO: 19 - protein, 14 aa, Artificial Sequence
  source: /note="Description of Artificial Sequence: Synthetic peptide"
AKEMLVQDYYYMDV

SEQ ID NO: 20 - protein, 448 aa, Artificial Sequence
  source: /note="Description of Artificial Sequence: Synthetic polypeptide"
QVQLVESGGGLVQPGGSLRLSCAASGFTFSSYGMHWVRQAPGKGLEWVAFIRYDGSNKYYADSVKGRFTISRDNSKNTLYLQMNSLRAEDTAVYYCAKEMLVQDYYYMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 21 - protein, 113 aa, Artificial Sequence
  source: /note="Description of Artificial Sequence: Synthetic polypeptide"
DVVMTQSPLSLPVSPGEPASISCRSSQNLLHRNGINYLNWYLQKPGQSPQLLIYWGSNRASGVPDRFSGSGSGTDFTLKISRVEAEDVGVYYCMQGLQIPPTFGQGTKVDIKR

SEQ ID NO: 22 - protein, 11 aa, Artificial Sequence
  source: /note="Description of Artificial Sequence: Synthetic peptide"
QNLLHRNGINY

SEQ ID NO: 23 - protein, 3 aa, Artificial Sequence
  source: /note="Description of Artificial Sequence: Synthetic peptide"
WGS

SEQ ID NO: 24 - protein, 9 aa, Artificial Sequence
  source: /note="Description of Artificial Sequence: Synthetic peptide"
MQGLQIPPT

SEQ ID NO: 25 - protein, 219 aa, Artificial Sequence
  source: /note="Description of Artificial Sequence: Synthetic polypeptide"
DVVMTQSPLSLPVSPGEPASISCRSSQNLLHRNGINYLNWYLQKPGQSPQLLIYWGSNRASGVPDRFSGSGSGTDFTLKISRVEAEDVGVYYCMQGLQIPPTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 121 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSS

SEQ ID NO: 27 - protein, 8 aa, Artificial Sequence
  source: /note="Description of Artificial Sequence: Synthetic peptide"
GFTFSSYA

SEQ ID NO: 28 - protein, 8 aa, Artificial Sequence
  source: /note="Description of Artificial Sequence: Synthetic peptide"
ISYDGSNK

SEQ ID NO: 29 - protein, 14 aa, Artificial Sequence
  source: /note="Description of Artificial Sequence: Synthetic peptide"
ARDPLPLHYYGMDV

SEQ ID NO: 30 - protein, 448 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 31 - protein, 111 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLSSLQLGGGTQLAVLG

SEQ ID NO: 32 - protein, 8 aa, Artificial Sequence
  source: /note="Description of Artificial Sequence: Synthetic peptide"
SSNMGRRP

SEQ ID NO: 33 - protein, 3 aa, Artificial Sequence
  source: /note="Description of Artificial Sequence: Synthetic peptide"
SQN

SEQ ID NO: 34 - protein, 11 aa, Artificial Sequence
  source: /note="Description of Artificial Sequence: Synthetic peptide"
AVWDDSLSSLQ

SEQ ID NO: 35 - protein, 216 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLSSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 36 - protein, 121 aa, Artificial Sequence; identical to SEQ ID NO: 26
  source: /note="Description of Artificial Sequence: Synthetic polypeptide"

SEQ ID NO: 37 - protein, 8 aa, Artificial Sequence
  source: /note="Description of Artificial Sequence: Synthetic peptide"
GFTFSSYA

SEQ ID NO: 38 - protein, 8 aa, Artificial Sequence
  source: /note="Description of Artificial Sequence: Synthetic peptide"
ISYDGSNK

SEQ ID NO: 39 - protein, 14 aa, Artificial Sequence
  source: /note="Description of Artificial Sequence: Synthetic peptide"
ARDPLPLHYYGMDV

SEQ ID NO: 40 - protein, 448 aa, Artificial Sequence; identical to SEQ ID NO: 30
  source: /note="Description of Artificial Sequence: Synthetic polypeptide"

SEQ ID NO: 41 - protein, 111 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLFSLLLGGGTQLAVLG

SEQ ID NO: 42 - protein, 8 aa, Artificial Sequence
  source: /note="Description of Artificial Sequence: Synthetic peptide"
SSNMGRRP

SEQ ID NO: 43 - protein, 3 aa, Artificial Sequence
  source: /note="Description of Artificial Sequence: Synthetic peptide"
SQN

SEQ ID NO: 44 - protein, 11 aa, Artificial Sequence
  source: /note="Description of Artificial Sequence: Synthetic peptide"
AVWDDSLFSLL

SEQ ID NO: 45 - protein, 216 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDSLFSLLLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 46 - protein, 121 aa, Artificial Sequence
  source: /note="Description of Artificial Sequence: Synthetic polypeptide"
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQGAAAGNPFDIWGQGTMVTVSS

SEQ ID NO: 47 - protein, 10 aa, Artificial Sequence
  source: /note="Description of Artificial Sequence: Synthetic peptide"
GGSISSSSYY

SEQ ID NO: 48 - protein, 7 aa, Artificial Sequence
  source: /note="Description of Artificial Sequence: Synthetic peptide"
IYYSGST

SEQ ID NO: 49 - protein, 13 aa, Artificial Sequence
  source: /note="Description of Artificial Sequence: Synthetic peptide"
ARQGAAAGNPFDI

SEQ ID NO: 50 - protein, 448 aa, Artificial Sequence
  source: /note="Description of Artificial Sequence: Synthetic polypeptide"
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQGAAAGNPFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 51 - protein, 111 aa, Artificial Sequence
  source: /note="Description of Artificial Sequence: Synthetic polypeptide"
QSVLTQPPSVSGTPGQRVTISCSGSSSNIGSNFVYWHQQLTGTAPKLLIYRNTQRPSGVPDRFSGSKSGTSASLAIGGLRSEDEADYYCATWDDSLSAWVFGGGTKLTVLG

SEQ ID NO: 52 - protein, 8 aa, Artificial Sequence
  source: /note="Description of Artificial Sequence: Synthetic peptide"
SSNIGSNF

SEQ ID NO: 53 - protein, 3 aa, Artificial Sequence
  source: /note="Description of Artificial Sequence: Synthetic peptide"
RNT

SEQ ID NO: 54 - protein, 11 aa, Artificial Sequence
  source: /note="Description of Artificial Sequence: Synthetic peptide"
ATWDDSLSAWV

SEQ ID NO: 55 - protein, 216 aa, Artificial Sequence
  source: /note="Description of Artificial Sequence: Synthetic polypeptide"
QSVLTQPPSVSGTPGQRVTISCSGSSSNIGSNFVYWHQQLTGTAPKLLIYRNTQRPSGVPDRFSGSKSGTSASLAIGGLRSEDEADYYCATWDDSLSAWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 56 - protein, 119 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARYSYGQYPYWGQGTLVTVSS

SEQ ID NO: 57 - protein, 8 aa, Artificial Sequence
  source: /note="Description of Artificial Sequence: Synthetic peptide"
GFTVSSNY

SEQ ID NO: 58 - protein, 7 aa, Artificial Sequence
  source: /note="Description of Artificial Sequence: Synthetic peptide"
IYSGGST

SEQ ID NO: 59 - protein, 13 aa, Artificial Sequence
  source: /note="Description of Artificial Sequence: Synthetic peptide"
ARGARYSYGQYPY

SEQ ID NO: 60 - protein, 446 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARYSYGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 61 - protein, 109 aa, Artificial Sequence
  source: /note="Description of Artificial Sequence: Synthetic polypeptide"
DIQLTQSPSFLSASVGDRVTITCRASHDISSLFSWYQQKPGKAPKLLIYAASTLQTGVPSRFSGSASGTEFTLTISSLQPEDFATYYCLQLDSFPTWTFGQGTKVEIKR

SEQ ID NO: 62 - protein, 6 aa, Artificial Sequence
  source: /note="Description of Artificial Sequence: Synthetic peptide"
HDISSL

SEQ ID NO: 63 - protein, 3 aa, Artificial Sequence
  source: /note="Description of Artificial Sequence: Synthetic peptide"
AAS

SEQ ID NO: 64 - protein, 10 aa, Artificial Sequence
  source: /note="Description of Artificial Sequence: Synthetic peptide"
LQLDSFPTWT

SEQ ID NO: 65 - protein, 215 aa, Artificial Sequence
  source: /note="Description of Artificial Sequence: Synthetic polypeptide"
DIQLTQSPSFLSASVGDRVTITCRASHDISSLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 121 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSS

SEQ ID NO: 67 - protein, 8 aa, Artificial Sequence
  source: /note="Description of Artificial Sequence: Synthetic peptide"
GFTFSSYA

SEQ ID NO: 68 - protein, 8 aa, Artificial Sequence
  source: /note="Description of Artificial Sequence: Synthetic peptide"
ISYDGTPV

SEQ ID NO: 69 - protein, 14 aa, Artificial Sequence
  source: /note="Description of Artificial Sequence: Synthetic peptide"
ARDPLPLHYYGMDV

SEQ ID NO: 70 - protein, 448 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDGTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 71 - protein, 111 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLG

SEQ ID NO: 72 - protein, 8 aa, Artificial Sequence
  source: /note="Description of Artificial Sequence: Synthetic peptide"
SSNMGRRP

SEQ ID NO: 73 - protein, 3 aa, Artificial Sequence
  source: /note="Description of Artificial Sequence: Synthetic peptide"
SQN

SEQ ID NO: 74 - protein, 11 aa, Artificial Sequence
  source: /note="Description of Artificial Sequence: Synthetic peptide"
AVWDGDRRSLQ

SEQ ID NO: 75 - protein, 216 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDGDRRSLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 76 - protein, 121 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSS

SEQ ID NO: 77 - protein, 8 aa, Artificial Sequence
  source: /note="Description of Artificial Sequence: Synthetic peptide"
GFTFSSYA

SEQ ID NO: 78 - protein, 8 aa, Artificial Sequence
  source: /note="Description of Artificial Sequence: Synthetic peptide"
ISYAGEVK

SEQ ID NO: 79 - protein, 14 aa, Artificial Sequence
  source: /note="Description of Artificial Sequence: Synthetic peptide"
ARDPLPLHYYGMDV

SEQ ID NO: 80 - protein, 448 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYAGEVKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 81 - protein, 111 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDIGRVLQLGGGTQLAVLG

SEQ ID NO: 82 - protein, 8 aa, Artificial Sequence
  source: /note="Description of Artificial Sequence: Synthetic peptide"
SSNMGRRP

SEQ ID NO: 83 - protein, 3 aa, Artificial Sequence
  source: /note="Description of Artificial Sequence: Synthetic peptide"
SQN

SEQ ID NO: 84 - protein, 11 aa, Artificial Sequence
  source: /note="Description of Artificial Sequence: Synthetic peptide"
AVWDDIGRVLQ

SEQ ID NO: 85 - protein, 216 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCAVWDDIGRVLQLGGGTQLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 86 - protein, 121 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDRTPVYYADSVKGRFTISRDNSKNTLYLQMNSLRAEDTAVYYCARDPLPLHYYGMDVWGQGTTVTVSS

SEQ ID NO: 87 - protein, 8 aa, Artificial Sequence
  source: /note="Description of Artificial Sequence: Synthetic peptide"
GFTFSSYA

SEQ ID NO: 88 - protein, 8 aa, Artificial Sequence
  source: /note="Description of Artificial Sequence: Synthetic peptide"
ISYDRTPV

SEQ ID NO: 89 - protein, 14 aa, Artificial Sequence
  source: /note="Description of Artificial Sequence: Synthetic peptide"
ARDPLPLHYYGMDV

SEQ ID NO: 90 - protein, 448 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDRTPVYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 91 - protein, 111 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSLPRLNFGGGTKLAVLG

SEQ ID NO: 92 - protein, 8 aa, Artificial Sequence
  source: /note="Description of Artificial Sequence: Synthetic peptide"
SSNMGRRP

SEQ ID NO: 93 - protein, 3 aa, Artificial Sequence
  source: /note="Description of Artificial Sequence: Synthetic peptide"
SQN

SEQ ID NO: 94 - protein, 11 aa, Artificial Sequence
  source: /note="Description of Artificial Sequence: Synthetic peptide"
ATWDDSLPRLN

SEQ ID NO: 95 - protein, 216 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSLPRLNFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 96 - protein, 121 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYEGDRKYYADSVKGRFTISRDNSKNTLYLQMNSLRAEDTAVYYCARDPLPLHYYGMDVWGQGTTVTVSS

SEQ ID NO: 97 - protein, 8 aa, Artificial Sequence
  source: /note="Description of Artificial Sequence: Synthetic peptide"
GFTFSSYA

SEQ ID NO: 98 - protein, 8 aa, Artificial Sequence
  source: /note="Description of Artificial Sequence: Synthetic peptide"
ISYEGDRK

SEQ ID NO: 99 - protein, 14 aa, Artificial Sequence
  source: /note="Description of Artificial Sequence: Synthetic peptide"
ARDPLPLHYYGMDV

SEQ ID NO: 100 - protein, 448 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYEGDRKYYADSVKGRFTISRDNSKNTLYLQMNSLRAEDTAVYYCARDPLPLHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 101 - protein, 111 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSTPHGVFGGGTKLAVLG

SEQ ID NO: 102 - protein, 8 aa, Artificial Sequence
  source: /note="Description of Artificial Sequence: Synthetic peptide"
SSNMGRRP

SEQ ID NO: 103 - protein, 3 aa, Artificial Sequence
  source: /note="Description of Artificial Sequence: Synthetic peptide"
SQN

SEQ ID NO: 104 - protein, 11 aa, Artificial Sequence
  source: /note="Description of Artificial Sequence: Synthetic peptide"
ATWDDSTPHGV

SEQ ID NO: 105 - protein, 216 aa, Artificial Sequence
  source: /note="Description of Artificial Sequence: Synthetic polypeptide"
QSALTQPRSASGNPGQRVTISCSGSSSNMGRRPVNWYQQIPGTAPKLLIYSQNQRPSGVPDRFSGSQSGTSASLTISGLQSEDEAEYFCATWDDSTPHGVFGGGTKLAVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 106 - protein, 118 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGAPLFGQYPYWGQGTLVTVSS

SEQ ID NO: 107 - protein, 8 aa, Artificial Sequence
  source: /note="Description of Artificial Sequence: Synthetic peptide"
GFTVSSNY

SEQ ID NO: 108 - protein, 7 aa, Artificial Sequence
  source: /note="Description of Artificial Sequence: Synthetic peptide"
IYSGGST

SEQ ID NO: 109 - protein, 12 aa, Artificial Sequence
  source: /note="Description of Artificial Sequence: Synthetic peptide"
ARGAPLFGQYPY

SEQ ID NO: 110 - protein, 445 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGAPLFGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 111 - protein, 109 aa, Artificial Sequence
  source: /note="Description of Artificial Sequence: Synthetic polypeptide"
DIQMTQSPSSLSASVGDRVTITCRASHAIASLFSWYQQKPGKAPKLLIYAASTLQTGVPSRFSGSASGTEFTLTISSLQPEDFATYYCLQLDSFPTWTFGQGTKVEIKR

SEQ ID NO: 112 - protein, 6 aa, Artificial Sequence
  source: /note="Description of Artificial Sequence: Synthetic peptide"
HAIASL

SEQ ID NO: 113 - protein, 3 aa, Artificial Sequence
  source: /note="Description of Artificial Sequence: Synthetic peptide"
AAS

SEQ ID NO: 114 - protein, 10 aa, Artificial Sequence
  source: /note="Description of Artificial Sequence: Synthetic peptide"
LQLDSFPTWT

SEQ ID NO: 115 - protein, 215 aa, Artificial Sequence
  source: /note="Description of Artificial Sequence: Synthetic polypeptide"
DIQMTQSPSSLSASVGDRVTITCRASHAIASLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 116 - protein, 118 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARPNGQYPYWGQGTLVTVSS

SEQ ID NO: 117 - protein, 8 aa, Artificial Sequence
  source: /note="Description of Artificial Sequence: Synthetic peptide"
GFTVSSNY

SEQ ID NO: 118 - protein, 7 aa, Artificial Sequence
  source: /note="Description of Artificial Sequence: Synthetic peptide"
IYSGGST

SEQ ID NO: 119 - protein, 12 aa, Artificial Sequence
  source: /note="Description of Artificial Sequence: Synthetic peptide"
ARGARPNGQYPY

SEQ ID NO: 120 - protein, 445 aa, Artificial Sequence
  source: /note="Description of Artificial Sequence: Synthetic polypeptide"
EVQLVETGGGLIQPGGSLRLSCAASGFTVSSNYMSWVRQAPGKGLEWVSVIYSGGSTYYADSVKGRFTISRDNSKNTLYLQMNSLRAEDTAVYYCARGARPNGQYPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 121 - protein, 109 aa, Artificial Sequence
  source: /note="Description of Artificial Sequence: Synthetic polypeptide"
DIQLTQSPSFLSASVGDRVTITCRASHGIKSLFSWYQQKPGKAPKLLIYAASTLQTGVPSRFSGSASGTEFTLTISSLQPEDFATYYCLQLDSFPTWTFGQGTKVEIKR

SEQ ID NO: 122 - protein, 6 aa, Artificial Sequence
  source: /note="Description of Artificial Sequence: Synthetic peptide"
HGIKSL

SEQ ID NO: 123 - protein, 3 aa, Artificial Sequence
  source: /note="Description of Artificial Sequence: Synthetic peptide"
AAS

SEQ ID NO: 124 - protein, 10 aa, Artificial Sequence
  source: /note="Description of Artificial Sequence: Synthetic peptide"
LQLDSFPTWT

SEQ ID NO: 125 - protein, 215 aa, Artificial Sequence
  source: /note="Description of Artificial Sequence: Synthetic polypeptide"
DIQLTQSPSFLSASVGDRVTITCRASHGIKSLFSWYQQKPGKAPKLLIYAASTLQTGVPSRFSGSASGTEFTLTISSLQPEDFATYYCLQLDSFPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 119 aa, Artificial Sequence
  source: /note="Description of Artificial Sequence: Synthetic polypeptide"
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSS

SEQ ID NO: 127 - protein, 8 aa, Artificial Sequence
  source: /note="Description of Artificial Sequence: Synthetic peptide"
GYTFSSYV

SEQ ID NO: 128 - protein, 8 aa, Artificial Sequence
  source: /note="Description of Artificial Sequence: Synthetic peptide"
IDPYNDGA

SEQ ID NO: 129 - protein, 12 aa, Artificial Sequence
  source: /note="Description of Artificial Sequence: Synthetic peptide"
ARGGPYGWYFDV

SEQ ID NO: 130 - protein, 446 aa, Artificial Sequence
  source: /note="Description of Artificial Sequence: Synthetic polypeptide"
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 131 - protein, 107 aa, Artificial Sequence
  source: /note="Description of Artificial Sequence: Synthetic polypeptide"
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELK

SEQ ID NO: 132 - protein, 6 aa, Artificial Sequence
  source: /note="Description of Artificial Sequence: Synthetic peptide"
EHIYSY

SEQ ID NO: 133 - protein, 3 aa, Artificial Sequence
  source: /note="Description of Artificial Sequence: Synthetic peptide"
NAK

SEQ ID NO: 134 - protein, 9 aa, Artificial Sequence
  source: /note="Description of Artificial Sequence: Synthetic peptide"
QHHFGSPLT

SEQ ID NO: 135 - protein, 214 aa, Artificial Sequence
  source: /note="Description of Artificial Sequence: Synthetic polypeptide"
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 130 aa, Artificial Sequence
  source: /note="Description of Artificial Sequence: Synthetic polypeptide"
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSS

SEQ ID NO: 137 - protein, 10 aa, Artificial Sequence
  source: /note="Description of Artificial Sequence: Synthetic peptide"
GGSVSSGIYY

SEQ ID NO: 138 - protein, 7 aa, Artificial Sequence
  source: /note="Description of Artificial Sequence: Synthetic peptide"
IYYSGST

SEQ ID NO: 139 - protein, 22 aa, Artificial Sequence
  source: /note="Description of Artificial Sequence: Synthetic peptide"
ARDYYVSGNYYNVDYYFFGVDV

SEQ ID NO: 140 - protein, 457 aa, Artificial Sequence
  source: /note="Description of Artificial Sequence: Synthetic polypeptide"
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 141 - protein, 109 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIK

SEQ ID NO: 142 - protein, 6 aa, Artificial Sequence
  source: /note="Description of Artificial Sequence: Synthetic peptide"
QSVSSY

SEQ ID NO: 143 - protein, 3 aa, Artificial Sequence
  source: /note="Description of Artificial Sequence: Synthetic peptide"
DAS

SEQ ID NO: 144 - protein, 11 aa, Artificial Sequence
  source: /note="Description of Artificial Sequence: Synthetic peptide"
QQRSNWPPLFT

SEQ ID NO: 145 - protein, 216 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 119 aa, Artificial Sequence
  source: /note="Description of Artificial Sequence: Synthetic polypeptide"
QVQLVQSGAEVKKPGASVKVSCKASGYTFTEYTLHWVRQAPGQGLEWMGGINPNNGGTSYAQKFQGRVTMTRDTSTSTVYMELSSLRSEDTAVYYCARSGYYDYSFAYWGQGTLVTVSS

SEQ ID NO: 147 - protein, 10 aa, Artificial Sequence
  source: /note="Description of Artificial Sequence: Synthetic peptide"
GYTFTEYTLH

SEQ ID NO: 148 - protein, 10 aa, Artificial Sequence
  source: /note="Description of Artificial Sequence: Synthetic peptide"
GINPNNGGTS

SEQ ID NO: 149 - protein, 10 aa, Artificial Sequence
  source: /note="Description of Artificial Sequence: Synthetic peptide"
SGYYDYSFAY

SEQ ID NO: 150 - protein, 446 aa, Artificial Sequence
  source: /note="Description of Artificial Sequence: Synthetic polypeptide"
QVQLVQSGAEVKKPGASVKVSCKASGYTFTEYTLHWVRQAPGQGLEWMGGINPNNGGTSYAQKFQGRVTMTRDTSTSTVYMELSSLRSEDTAVYYCARSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 151 - protein, 107 aa, Artificial Sequence
  source: /note="Description of Artificial Sequence: Synthetic polypeptide"
DIQMTQSPSSLSASVGDRVTITCRASQDVKNAVVWYQQKPGKAPKLLIYSPSYRYTGVPSRFSGSGSGTDFTLTISSLQPEDFATYYCQQHYSTPFTFGQGTKLEIK

SEQ ID NO: 152 - protein, 11 aa, Artificial Sequence
  source: /note="Description of Artificial Sequence: Synthetic peptide"
RASQDVKNAVV

SEQ ID NO: 153 - protein, 7 aa, Artificial Sequence
  source: /note="Description of Artificial Sequence: Synthetic peptide"
SPSYRYT

SEQ ID NO: 154 - protein, 9 aa, Artificial Sequence
  source: /note="Description of Artificial Sequence: Synthetic peptide"
QQHYSTPFT

SEQ ID NO: 155 - protein, 214 aa, Artificial Sequence
  source: /note="Description of Artificial Sequence: Synthetic polypeptide"
DIQMTQSPSSLSASVGDRVTITCRASQDVKNAVVWYQQKPGKAPKLLIYSPSYRYTGVPSRFSGSGSGTDFTLTISSLQPEDFATYYCQQHYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 156 - protein, 119 aa, Artificial Sequence
  source: /note="Description of Artificial Sequence: Synthetic polypeptide"
QVQLVQSGAEVKKPGASVKVSCKTSGYTFTEYTLHWVRQAPGQGLEWIGGINPNNGGTSYAQKFQGRVTMTVDTSTSTVYMELSSLRSEDTAVYYCAGSGYYDYSFAYWGQGTLVTVSS

SEQ ID NO: 157 - protein, 10 aa, Artificial Sequence
  source: /note="Description of Artificial Sequence: Synthetic peptide"
GYTFTEYTLH

SEQ ID NO: 158 - protein, 10 aa, Artificial Sequence
  source: /note="Description of Artificial Sequence: Synthetic peptide"
GINPNNGGTS

SEQ ID NO: 159 - protein, 10 aa, Artificial Sequence
  source: /note="Description of Artificial Sequence: Synthetic peptide"
SGYYDYSFAY

SEQ ID NO: 160 - protein, 446 aa, Artificial Sequence
  source: /note="Description of Artificial Sequence: Synthetic polypeptide"
QVQLVQSGAEVKKPGASVKVSCKTSGYTFTEYTLHWVRQAPGQGLEWIGGINPNNGGTSYAQKFQGRVTMTVDTSTSTVYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 161 - protein, 107 aa, Artificial Sequence; identical to SEQ ID NO: 151
  source: /note="Description of Artificial Sequence: Synthetic polypeptide"

SEQ ID NO: 162 - protein, 11 aa, Artificial Sequence
  source: /note="Description of Artificial Sequence: Synthetic peptide"
RASQDVKNAVV

SEQ ID NO: 163 - protein, 7 aa, Artificial Sequence
  source: /note="Description of Artificial Sequence: Synthetic peptide"
SPSYRYT

SEQ ID NO: 164 - protein, 9 aa, Artificial Sequence
  source: /note="Description of Artificial Sequence: Synthetic peptide"
QQHYSTPFT

SEQ ID NO: 165 - protein, 214 aa, Artificial Sequence; identical to SEQ ID NO: 155
  source: /note="Description of Artificial Sequence: Synthetic polypeptide"

SEQ ID NO: 166 - protein, 119 aa, Artificial Sequence; identical to SEQ ID NO: 156
  source: /note="Description of Artificial Sequence: Synthetic polypeptide"

SEQ ID NO: 167 - protein, 10 aa, Artificial Sequence
  source: /note="Description of Artificial Sequence: Synthetic peptide"
GYTFTEYTLH

SEQ ID NO: 168 - protein, 10 aa, Artificial Sequence
  source: /note="Description of Artificial Sequence: Synthetic peptide"
GINPNNGGTS

SEQ ID NO: 169 - protein, 10 aa, Artificial Sequence
  source: /note="Description of Artificial Sequence: Synthetic peptide"
SGYYDYSFAY

SEQ ID NO: 170 - protein, 446 aa, Artificial Sequence; identical to SEQ ID NO: 160
  source: /note="Description of Artificial Sequence: Synthetic polypeptide"

SEQ ID NO: 171 - protein, 107 aa, Artificial Sequence
  source: /note="Description of Artificial Sequence: Synthetic polypeptide"
DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIK

SEQ ID NO: 172 - protein, 11 aa, Artificial Sequence
  source: /note="Description of Artificial Sequence: Synthetic peptide"
RASQDVKNAVV

SEQ ID NO: 173 - protein, 7 aa, Artificial Sequence
  source: /note="Description of Artificial Sequence: Synthetic peptide"
SPSYRYT

SEQ ID NO: 174 - protein, 9 aa, Artificial Sequence
  source: /note="Description of Artificial Sequence: Synthetic peptide"
QQHYSTPFT

SEQ ID NO: 175 - protein, 214 aa, Artificial Sequence
  source: /note="Description of Artificial Sequence: Synthetic polypeptide"
DIQMTQSPSSLSASVGDRVTITCRASQDVKNAVVWYQQKPGKAPKLLIYSPSYRYTGVPSRFSGSGSGTDFTFTISSVQPEDFATYYCQQHYSTPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 119 aa, Artificial Sequence
  source: /note="Description of Artificial Sequence: Synthetic polypeptide"
QVQLVQSGAEVKKPGASVKISCKTSGYTFTEYTLHWVRQAPGQGLEWIGGINPNNGGTSYAQKFQGRATLTVDTSTSTAYMELSSLRSEDTAVYYCAGSGYYDYSFAYWGQGTLVTVSS

SEQ ID NO: 177 - protein, 10 aa, Artificial Sequence
  source: /note="Description of Artificial Sequence: Synthetic peptide"
GYTFTEYTLH

SEQ ID NO: 178 - protein, 10 aa, Artificial Sequence
  source: /note="Description of Artificial Sequence: Synthetic peptide"
GINPNNGGTS

SEQ ID NO: 179 - protein, 10 aa, Artificial Sequence
  source: /note="Description of Artificial Sequence: Synthetic peptide"
SGYYDYSFAY

SEQ ID NO: 180 - protein, 446 aa, Artificial Sequence
  source: /note="Description of Artificial Sequence: Synthetic polypeptide"
QVQLVQSGAEVKKPGASVKISCKTSGYTFTEYTLHWVRQAPGQGLEWIGGINPNNGGTSYAQKFQGRATLTVDTSTSTAYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 181 - protein, 107 aa, Artificial Sequence; identical to SEQ ID NO: 151
  source: /note="Description of Artificial Sequence: Synthetic polypeptide"

SEQ ID NO: 182 - protein, 11 aa, Artificial Sequence
  source: /note="Description of Artificial Sequence: Synthetic peptide"
RASQDVKNAVV

SEQ ID NO: 183 - protein, 7 aa, Artificial Sequence
  source: /note="Description of Artificial Sequence: Synthetic peptide"
SPSYRYT

SEQ ID NO: 184 - protein, 9 aa, Artificial Sequence
  source: /note="Description of Artificial Sequence: Synthetic peptide"
QQHYSTPFT

SEQ ID NO: 185 - protein, 214 aa, Artificial Sequence; identical to SEQ ID NO: 155
  source: /note="Description of Artificial Sequence: Synthetic polypeptide"

SEQ ID NO: 186 - protein, 119 aa, Artificial Sequence; identical to SEQ ID NO: 176
  source: /note="Description of Artificial Sequence: Synthetic polypeptide"

SEQ ID NO: 187 - protein, 10 aa, Artificial Sequence
  source: /note="Description of Artificial Sequence: Synthetic peptide"
GYTFTEYTLH

SEQ ID NO: 188 - protein, 10 aa, Artificial Sequence
  source: /note="Description of Artificial Sequence: Synthetic peptide"
GINPNNGGTS

SEQ ID NO: 189 - protein, 10 aa, Artificial Sequence
  source: /note="Description of Artificial Sequence: Synthetic peptide"
SGYYDYSFAY

SEQ ID NO: 190 - protein, 446 aa, Artificial Sequence; identical to SEQ ID NO: 180
  source: /note="Description of Artificial Sequence: Synthetic polypeptide"

SEQ ID NO: 191 - protein, 107 aa, Artificial Sequence; identical to SEQ ID NO: 171
  source: /note="Description of Artificial Sequence: Synthetic polypeptide"

SEQ ID NO: 192 - protein, 11 aa, Artificial Sequence
  source: /note="Description of Artificial Sequence: Synthetic peptide"
RASQDVKNAVV

SEQ ID NO: 193 - protein, 7 aa, Artificial Sequence
  source: /note="Description of Artificial Sequence: Synthetic peptide"
SPSYRYT

SEQ ID NO: 194 - protein, 9 aa, Artificial Sequence
  source: /note="Description of Artificial Sequence: Synthetic peptide"
QQHYSTPFT

SEQ ID NO: 195 - protein, 214 aa, Artificial Sequence; identical to SEQ ID NO: 175
  source: /note="Description of Artificial Sequence: Synthetic polypeptide"

SEQ ID NO: 196 - protein, 119 aa, Artificial Sequence
  source: /note="Description of Artificial Sequence: Synthetic polypeptide"
QVQLVQSGAEVKKPGASVKISCKTSGYTFTEYTLHWVRQAPGQGLEWIGGINPNNGGTSYAQKFQGRATLTVDKSTSTAYMELSSLRSEDTAVYYCAGSGYYDYSFAYWGQGTLVTVSS

SEQ ID NO: 197 - protein, 10 aa, Artificial Sequence
  source: /note="Description of Artificial Sequence: Synthetic peptide"
GYTFTEYTLH

SEQ ID NO: 198 - protein, 10 aa, Artificial Sequence
  source: /note="Description of Artificial Sequence: Synthetic peptide"
GINPNNGGTS

SEQ ID NO: 199 - protein, 10 aa, Artificial Sequence
  source: /note="Description of Artificial Sequence: Synthetic peptide"
SGYYDYSFAY

SEQ ID NO: 200 - protein, 446 aa, Artificial Sequence
  source: /note="Description of Artificial Sequence: Synthetic polypeptide"
QVQLVQSGAEVKKPGASVKISCKTSGYTFTEYTLHWVRQAPGQGLEWIGGINPNNGGTSYAQKFQGRATLTVDKSTSTAYMELSSLRSEDTAVYYCAGSGYYDYSFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 201 - protein, 107 aa, Artificial Sequence; identical to SEQ ID NO: 151
  source: /note="Description of Artificial Sequence: Synthetic polypeptide"

SEQ ID NO: 202 - protein, 11 aa, Artificial Sequence
  source: /note="Description of Artificial Sequence: Synthetic peptide"
RASQDVKNAVV

SEQ ID NO: 203 - protein, 7 aa, Artificial Sequence
  source: /note="Description of Artificial Sequence: Synthetic peptide"
SPSYRYT

SEQ ID NO: 204 - protein, 9 aa, Artificial Sequence
  source: /note="Description of Artificial Sequence: Synthetic peptide"
QQHYSTPFT

SEQ ID NO: 205 - protein, 214 aa, Artificial Sequence; identical to SEQ ID NO: 155
  source: /note="Description of Artificial Sequence: Synthetic polypeptide"

SEQ ID NO: 206 - protein, 119 aa, Artificial Sequence; identical to SEQ ID NO: 196
  source: /note="Description of Artificial Sequence: Synthetic polypeptide"

SEQ ID NO: 207 - protein, 10 aa, Artificial Sequence
  source: /note="Description of Artificial Sequence: Synthetic peptide"
GYTFTEYTLH

SEQ ID NO: 208 - protein, 10 aa, Artificial Sequence
  source: /note="Description of Artificial Sequence: Synthetic peptide"
GINPNNGGTS

SEQ ID NO: 209 - protein, 10 aa, Artificial Sequence
  source: /note="Description of Artificial Sequence: Synthetic peptide"
SGYYDYSFAY

SEQ ID NO: 210 - protein, 446 aa, Artificial Sequence; identical to SEQ ID NO: 200
  source: /note="Description of Artificial Sequence: Synthetic polypeptide"

SEQ ID NO: 211 - protein, 107 aa, Artificial Sequence; identical to SEQ ID NO: 171
  source: /note="Description of Artificial Sequence: Synthetic polypeptide"

SEQ ID NO: 212 - protein, 11 aa, Artificial Sequence
  source: /note="Description of Artificial Sequence: Synthetic peptide"
RASQDVKNAVV

SEQ ID NO: 213 - protein, 7 aa, Artificial Sequence
  source: /note="Description of Artificial Sequence: Synthetic peptide"
SPSYRYT

SEQ ID NO: 214 - protein, 9 aa, Artificial Sequence
  source: /note="Description of Artificial Sequence: Synthetic peptide"
QQHYSTPFT

SEQ ID NO: 215 - protein, 214 aa, Artificial Sequence; identical to SEQ ID NO: 175
  source: /note="Description of Artificial Sequence: Synthetic polypeptide"

SEQ ID NO: 216 - protein, 119 aa, Artificial Sequence
  source: /note="Description of Artificial Sequence: Synthetic polypeptide"
QVQLVQSGAEVKKPGASVKVSCKASGYTFTNYGMNWVRQAPGQGLEWMGWINTYTGEPTYAQKFQGRVTMTRDTSTSTVYMELSSLRSEDTAVYYCARGNGYYVGMDYWGQGTLVTVSS

SEQ ID NO: 217 - protein, 10 aa, Artificial Sequence
  source: /note="Description of Artificial Sequence: Synthetic peptide"
GYTFTNYGMN

SEQ ID NO: 218 - protein, 10 aa, Artificial Sequence
  source: /note="Description of Artificial Sequence: Synthetic peptide"
WINTYTGEPT

SEQ ID NO: 219 - protein, 10 aa, Artificial Sequence
  source: /note="Description of Artificial Sequence: Synthetic peptide"
GNGYYVGMDY

SEQ ID NO: 220 - protein, 446 aa, Artificial Sequence
  source: /note="Description of Artificial Sequence: Synthetic polypeptide"
QVQLVQSGAEVKKPGASVKVSCKASGYTFTNYGMNWVRQAPGQGLEWMGWINTYTGEPTYAQKFQGRVTMTRDTSTSTVYMELSSLRSEDTAVYYCARGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 221 - protein, 109 aa, Artificial Sequence
  source: /note="Description of Artificial Sequence: Synthetic polypeptide"
QAVVTQEPSLTVSPGGTVTLTCRSSTGAVTTSNHANWFQQKPGQAPRTLIYGTNGRGSWTPARFSGSLLGGKAALTLSGAQPEDEAEYYCALWFSNHWVFGGGTKLTVL

SEQ ID NO: 222 - protein, 14 aa, Artificial Sequence
  source: /note="Description of Artificial Sequence: Synthetic peptide"
RSSTGAVTTSNHAN

SEQ ID NO: 223 - protein, 7 aa, Artificial Sequence
  source: /note="Description of Artificial Sequence: Synthetic peptide"
GTNGRGS

SEQ ID NO: 224 - protein, 9 aa, Artificial Sequence
  source: /note="Description of Artificial Sequence: Synthetic peptide"
ALWFSNHWV

SEQ ID NO: 225 - protein, 214 aa, Artificial Sequence
  source: /note="Description of Artificial Sequence: Synthetic polypeptide"
QAVVTQEPSLTVSPGGTVTLTCRSSTGAVTTSNHANWFQQKPGQAPRTLIYGTNGRGSWTPARFSGSLLGGKAALTLSGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 226 - protein, 119 aa, Artificial Sequence
  source: /note="Description of Artificial Sequence: Synthetic polypeptide"
QVQLVQSGAEVKKPGASVKVSCKASGYTFTNYGMNWVRQAPGQGLEWMGWINTYTGEPTYAQKFQGRVTMTLDTSTSTAYMELSSLRSEDTAVYYCSRGNGYYVGMDYWGQGTLVTVSS

SEQ ID NO: 227 - protein, 10 aa, Artificial Sequence
  source: /note="Description of Artificial Sequence: Synthetic peptide"
GYTFTNYGMN

SEQ ID NO: 228 - protein, 10 aa, Artificial Sequence
  source: /note="Description of Artificial Sequence: Synthetic peptide"
WINTYTGEPT

SEQ ID NO: 229 - protein, 10 aa, Artificial Sequence
  source: /note="Description of Artificial Sequence: Synthetic peptide"
GNGYYVGMDY

SEQ ID NO: 230 - protein, 446 aa, Artificial Sequence
  source: /note="Description of Artificial Sequence: Synthetic polypeptide"
QVQLVQSGAEVKKPGASVKVSCKASGYTFTNYGMNWVRQAPGQGLEWMGWINTYTGEPTYAQKFQGRVTMTLDTSTSTAYMELSSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 231 - protein, 109 aa, Artificial Sequence
  source: /note="Description of Artificial Sequence: Synthetic polypeptide"
QAVVTQEPSLTVSPGGTVTLTCGSSTGAVTTSNHANWVQQKPGQAFRGLIRGTNGRGSWTPARFSGSLLGGKAALTISGAQPEDEAEYYCALWFSNHWVFGGGTKLTVL

SEQ ID NO: 232 - protein, 14 aa, Artificial Sequence
  source: /note="Description of Artificial Sequence: Synthetic peptide"
GSSTGAVTTSNHAN

SEQ ID NO: 233 - protein, 7 aa, Artificial Sequence
  source: /note="Description of Artificial Sequence: Synthetic peptide"
GTNGRGS

SEQ ID NO: 234 - protein, 9 aa, Artificial Sequence
  source: /note="Description of Artificial Sequence: Synthetic peptide"
ALWFSNHWV

SEQ ID NO: 235 - protein, 214 aa, Artificial Sequence
  source: /note="Description of Artificial Sequence: Synthetic polypeptide"
QAVVTQEPSLTVSPGGTVTLTCGSSTGAVTTSNHANWVQQKPGQAFRGLIRGTNGRGSWTPARFSGSLLGGKAALTISGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 236 - protein, 119 aa, Artificial Sequence; identical to SEQ ID NO: 226
  source: /note="Description of Artificial Sequence: Synthetic polypeptide"

SEQ ID NO: 237 - protein, 10 aa, Artificial Sequence
  source: /note="Description of Artificial Sequence: Synthetic peptide"
GYTFTNYGMN

SEQ ID NO: 238 - protein, 10 aa, Artificial Sequence
  source: /note="Description of Artificial Sequence: Synthetic peptide"
WINTYTGEPT

SEQ ID NO: 239 - protein, 10 aa, Artificial Sequence
  source: /note="Description of Artificial Sequence: Synthetic peptide"
GNGYYVGMDY

SEQ ID NO: 240 - protein, 446 aa, Artificial Sequence; identical to SEQ ID NO: 230
  source: /note="Description of Artificial Sequence: Synthetic polypeptide"

SEQ ID NO: 241 - protein, 109 aa, Artificial Sequence
  source: /note="Description of Artificial Sequence: Synthetic polypeptide"
QAVVTQEPSLTVSPGGTVTLTCGSSTGAVTTSNHANWVQQKPGQAFRGLIRGTNGRGSGVPARFSGSLLGGKAALTISGAQPEDEAEYYCALWFSNHWVFGGGTKLTVL

SEQ ID NO: 242 - protein, 14 aa, Artificial Sequence
  source: /note="Description of Artificial Sequence: Synthetic peptide"
GSSTGAVTTSNHAN

SEQ ID NO: 243 - protein, 7 aa, Artificial Sequence
  source: /note="Description of Artificial Sequence: Synthetic peptide"
GTNGRGS

SEQ ID NO: 244 - protein, 9 aa, Artificial Sequence
  source: /note="Description of Artificial Sequence: Synthetic peptide"
ALWFSNHWV

SEQ ID NO: 245 - protein, 214 aa, Artificial Sequence
  source: /note="Description of Artificial Sequence: Synthetic polypeptide"
QAVVTQEPSLTVSPGGTVTLTCGSSTGAVTTSNHANWVQQKPGQAFRGLIRGTNGRGSGVPARFSGSLLGGKAALTISGAQPEDEAEYYCALWFSNHWVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 246 - protein, 119 aa, Artificial Sequence
  source: /note="Description of Artificial Sequence: Synthetic polypeptide"
QVQLVQSGAEVKKPGASVKISCKASGYTFTNYGMNWVRQAPGQGLEWMGWINTYTGEPTYAQKFQGRFTFTLDTSTSTAYLEISSLRSEDTAVYYCSRGNGYYVGMDYWGQGTLVTVSS

SEQ ID NO: 247 - protein, 10 aa, Artificial Sequence
  source: /note="Description of Artificial Sequence: Synthetic peptide"
GYTFTNYGMN

SEQ ID NO: 248 - protein, 10 aa, Artificial Sequence
  source: /note="Description of Artificial Sequence: Synthetic peptide"
WINTYTGEPT

SEQ ID NO: 249 - protein, 10 aa, Artificial Sequence
  source: /note="Description of Artificial Sequence: Synthetic peptide"
GNGYYVGMDY

SEQ ID NO: 250 - protein, 446 aa, Artificial Sequence
  source: /note="Description of Artificial Sequence: Synthetic polypeptide"
QVQLVQSGAEVKKPGASVKISCKASGYTFTNYGMNWVRQAPGQGLEWMGWINTYTGEPTYAQKFQGRFTFTLDTSTSTAYLEISSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 251 - protein, 109 aa, Artificial Sequence; identical to SEQ ID NO: 231
  source: /note="Description of Artificial Sequence: Synthetic polypeptide"

SEQ ID NO: 252 - protein, 14 aa, Artificial Sequence
  source: /note="Description of Artificial Sequence: Synthetic peptide"
GSSTGAVTTSNHAN

SEQ ID NO: 253 - protein, 7 aa, Artificial Sequence
  source: /note="Description of Artificial Sequence: Synthetic peptide"
GTNGRGS

SEQ ID NO: 254 - protein, 9 aa, Artificial Sequence
  source: /note="Description of Artificial Sequence: Synthetic peptide"
ALWFSNHWV

SEQ ID NO: 255 - protein, 214 aa, Artificial Sequence; identical to SEQ ID NO: 235
  source: /note="Description of Artificial Sequence: Synthetic polypeptide"

SEQ ID NO: 256 - protein, 119 aa, Artificial Sequence; identical to SEQ ID NO: 246
  source: /note="Description of Artificial Sequence: Synthetic polypeptide"

SEQ ID NO: 257 - protein, 10 aa, Artificial Sequence
  source: /note="Description of Artificial Sequence: Synthetic peptide"
GYTFTNYGMN

SEQ ID NO: 258 - protein, 10 aa, Artificial Sequence
  source: /note="Description of Artificial Sequence: Synthetic peptide"
WINTYTGEPT

SEQ ID NO: 259 - protein, 10 aa, Artificial Sequence
  source: /note="Description of Artificial Sequence: Synthetic peptide"
GNGYYVGMDY

SEQ ID NO: 260 - protein, 446 aa, Artificial Sequence; identical to SEQ ID NO: 250
  source: /note="Description of Artificial Sequence: Synthetic polypeptide"

SEQ ID NO: 261 - protein, 109 aa, Artificial Sequence; identical to SEQ ID NO: 241
  source: /note="Description of Artificial Sequence: Synthetic polypeptide"

SEQ ID NO: 262 - protein, 14 aa, Artificial Sequence
  source: /note="Description of Artificial Sequence: Synthetic peptide"
GSSTGAVTTSNHAN

SEQ ID NO: 263 - protein, 7 aa, Artificial Sequence
  source: /note="Description of Artificial Sequence: Synthetic peptide"
GTNGRGS

SEQ ID NO: 264 - protein, 9 aa, Artificial Sequence
  source: /note="Description of Artificial Sequence: Synthetic peptide"
ALWFSNHWV

SEQ ID NO: 265 - protein, 214 aa, Artificial Sequence; identical to SEQ ID NO: 245
  source: /note="Description of Artificial Sequence: Synthetic polypeptide"

SEQ ID NO: 266 - protein, 119 aa, Artificial Sequence
  source: /note="Description of Artificial Sequence: Synthetic polypeptide"
QVQLVQSGAEVKKPGASVKISCKASGYTFTNYGMNWVRQAPGQGLEWMGWINTYTGEPTYAQKFQGRFTFTLDASTSTAYLEISSLRSEDTAVYYCSRGNGYYVGMDYWGQGTLVTVSS

SEQ ID NO: 267 - protein, 10 aa, Artificial Sequence
  source: /note="Description of Artificial Sequence: Synthetic peptide"
GYTFTNYGMN

SEQ ID NO: 268 - protein, 10 aa, Artificial Sequence
  source: /note="Description of Artificial Sequence: Synthetic peptide"
WINTYTGEPT

SEQ ID NO: 269 - protein, 10 aa, Artificial Sequence
  source: /note="Description of Artificial Sequence: Synthetic peptide"
GNGYYVGMDY

SEQ ID NO: 270 - protein, 446 aa, Artificial Sequence; identical to SEQ ID NO: 250
  source: /note="Description of Artificial Sequence: Synthetic polypeptide"

SEQ ID NO: 271 - protein, 109 aa, Artificial Sequence; identical to SEQ ID NO: 231
  source: /note="Description of Artificial Sequence: Synthetic polypeptide"

SEQ ID NO: 272 - protein, 14 aa, Artificial Sequence
  source: /note="Description of Artificial Sequence: Synthetic peptide"
GSSTGAVTTSNHAN

SEQ ID NO: 273 - protein, 7 aa, Artificial Sequence
  source: /note="Description of Artificial Sequence: Synthetic peptide"
GTNGRGS

SEQ ID NO: 274 - protein, 9 aa, Artificial Sequence
  source: /note="Description of Artificial Sequence: Synthetic peptide"
ALWFSNHWV

SEQ ID NO: 275 - protein, 214 aa, Artificial Sequence; identical to SEQ ID NO: 235
  source: /note="Description of Artificial Sequence: Synthetic polypeptide"

SEQ ID NO: 276 - protein, 119 aa, Artificial Sequence; identical to SEQ ID NO: 266
  source: /note="Description of Artificial Sequence: Synthetic polypeptide"

SEQ ID NO: 277 - protein, 10 aa, Artificial Sequence
  source: /note="Description of Artificial Sequence: Synthetic peptide"
GYTFTNYGMN

SEQ ID NO: 278 - protein, 10 aa, Artificial Sequence
  source: /note="Description of Artificial Sequence: Synthetic peptide"
WINTYTGEPT

SEQ ID NO: 279 - protein, 10 aa, Artificial Sequence
  source: /note="Description of Artificial Sequence: Synthetic peptide"
GNGYYVGMDY

SEQ ID NO: 280 - protein, 446 aa, Artificial Sequence
  source: /note="Description of Artificial Sequence: Synthetic polypeptide"
QVQLVQSGAEVKKPGASVKISCKASGYTFTNYGMNWVRQAPGQGLEWMGWINTYTGEPTYAQKFQGRFTFTLDASTSTAYLEISSLRSEDTAVYYCSRGNGYYVGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 281 - protein, 109 aa, Artificial Sequence; identical to SEQ ID NO: 241
  source: /note="Description of Artificial Sequence: Synthetic polypeptide"

SEQ ID NO: 282 - protein, 14 aa, Artificial Sequence
  source: /note="Description of Artificial Sequence: Synthetic peptide"
GSSTGAVTTSNHAN

SEQ ID NO: 283 - protein, 7 aa, Artificial Sequence
  source: /note="Description of Artificial Sequence: Synthetic peptide"
GTNGRGS

SEQ ID NO: 284 - protein, 9 aa, Artificial Sequence
  source: /note="Description of Artificial Sequence: Synthetic peptide"
ALWFSNHWV

SEQ ID NO: 285 - protein, 214 aa, Artificial Sequence; identical to SEQ ID NO: 245
  source: /note="Description of Artificial Sequence: Synthetic polypeptide"

SEQ ID NO: 286 - protein, 119 aa, Artificial Sequence
  source: /note="Description of Artificial Sequence: Synthetic polypeptide"
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCARWLLSYYAMDYWGQGTLVTVSS

SEQ ID NO: 287 - protein, 10 aa, Artificial Sequence
  source: /note="Description of Artificial Sequence: Synthetic peptide"
GFTFSSYIMS

SEQ ID NO: 288 - protein, 10 aa, Artificial Sequence
  source: /note="Description of Artificial Sequence: Synthetic peptide"
TISGGGTNTY

SEQ ID NO: 289 - protein, 10 aa, Artificial Sequence
  source: /note="Description of Artificial Sequence: Synthetic peptide"
WLLSYYAMDY

SEQ ID NO: 290 - protein, 446 aa, Artificial Sequence
  source: /note="Description of Artificial Sequence: Synthetic polypeptide"
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCARWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 291 - protein, 107 aa, Artificial Sequence
  source: /note="Description of Artificial Sequence: Synthetic polypeptide"
DIQMTQSPSSLSASVGDRVTITCRASQNINVWLTWYQQKPGKAPKLLIYKASNLHTGVPSRFSGSGSGTDFTLTISSLQPEDFATYYCQQGQSYPYTFGQGTKLEIK

SEQ ID NO: 292 - protein, 11 aa, Artificial Sequence
  source: /note="Description of Artificial Sequence: Synthetic peptide"
RASQNINVWLT

SEQ ID NO: 293 - protein, 7 aa, Artificial Sequence
  source: /note="Description of Artificial Sequence: Synthetic peptide"
KASNLHT

SEQ ID NO: 294 - protein, 9 aa, Artificial Sequence
  source: /note="Description of Artificial Sequence: Synthetic peptide"
QQGQSYPYT

SEQ ID NO: 295 - protein, 214 aa, Artificial Sequence
  source: /note="Description of Artificial Sequence: Synthetic polypeptide"
DIQMTQSPSSLSASVGDRVTITCRASQNINVWLTWYQQKPGKAPKLLIYKASNLHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 119 aa, Artificial Sequence
  source: /note="Description of Artificial Sequence: Synthetic polypeptide"
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCAKWLLSYYAMDYWGQGTLVTVSS

SEQ ID NO: 297 - protein, 10 aa, Artificial Sequence
  source: /note="Description of Artificial Sequence: Synthetic peptide"
GFTFSSYIMS

SEQ ID NO: 298 - protein, 10 aa, Artificial Sequence
  source: /note="Description of Artificial Sequence: Synthetic peptide"
TISGGGTNTY

SEQ ID NO: 299 - protein, 10 aa, Artificial Sequence
  source: /note="Description of Artificial Sequence: Synthetic peptide"
WLLSYYAMDY

SEQ ID NO: 300 - protein, 446 aa, Artificial Sequence
  source: /note="Description of Artificial Sequence: Synthetic polypeptide"
EVQLVESGGGLVQPGGSLRLSCAASGFTFSSYIMSWVRQAPGKGLEWVSTISGGGTNTYYADSVKGRFTISRDNSKNTLYLQMNSLRAEDTAVYYCAKWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 301 - protein, 107 aa, Artificial Sequence; identical to SEQ ID NO: 291
  source: /note="Description of Artificial Sequence: Synthetic polypeptide"

SEQ ID NO: 302 - protein, 11 aa, Artificial Sequence
  source: /note="Description of Artificial Sequence: Synthetic peptide"
RASQNINVWLT

SEQ ID NO: 303 - protein, 7 aa, Artificial Sequence
  source: /note="Description of Artificial Sequence: Synthetic peptide"
KASNLHT

SEQ ID NO: 304 - protein, 9 aa, Artificial Sequence
  source: /note="Description of Artificial Sequence: Synthetic peptide"
QQGQSYPYT

SEQ ID NO: 305 - protein, 214 aa, Artificial Sequence; identical to SEQ ID NO: 295
  source: /note="Description of Artificial Sequence: Synthetic polypeptide"

SEQ ID NO: 306 - protein, 119 aa, Artificial Sequence
  source: /note="Description of Artificial Sequence: Synthetic polypeptide"
EVQLVESGGGLVQPGGSLRLSCAASGFTFSSYIMSWVRQAPGKGLEWVATISGGGTNTYYADSVKGRFTISRDNSKNTLYLQMNSLRAEDTAVYYCAKWLLSYYAMDYWGQGTLVTVSS

SEQ ID NO: 307 - protein, 10 aa, Artificial Sequence
  source: /note="Description of Artificial Sequence: Synthetic peptide"
GFTFSSYIMS

SEQ ID NO: 308 - protein, 10 aa, Artificial Sequence
  source: /note="Description of Artificial Sequence: Synthetic peptide"
TISGGGTNTY

SEQ ID NO: 309 - protein, 10 aa, Artificial Sequence
  source: /note="Description of Artificial Sequence: Synthetic peptide"
WLLSYYAMDY

SEQ ID NO: 310 - protein, 446 aa, Artificial Sequence
  source: /note="Description of Artificial Sequence: Synthetic polypeptide"
EVQLVESGGGLVQPGGSLRLSCAASGFTFSSYIMSWVRQAPGKGLEWVATISGGGTNTYYADSVKGRFTISRDNSKNTLYLQMNSLRAEDTAVYYCAKWLLSYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 311 - protein, 107 aa, Artificial Sequence; identical to SEQ ID NO: 291
  source: /note="Description of Artificial Sequence: Synthetic polypeptide"

SEQ ID NO: 312 - protein, 11 aa, Artificial Sequence
  source: /note="Description of Artificial Sequence: Synthetic peptide"
RASQNINVWLT

SEQ ID NO: 313 - protein, 7 aa, Artificial Sequence
  source: /note="Description of Artificial Sequence: Synthetic peptide"
KASNLHT

SEQ ID NO: 314 - protein, 9 aa, Artificial Sequence
  source: /note="Description of Artificial Sequence: Synthetic peptide"
QQGQSYPYT

SEQ ID NO: 315 - protein, 214 aa, Artificial Sequence; identical to SEQ ID NO: 295
  source: /note="Description of Artificial Sequence: Synthetic polypeptide"

SEQ ID NO: 316 - protein, 119 aa, Artificial Sequence; identical to SEQ ID NO: 296
  source: /note="Description of Artificial Sequence: Synthetic polypeptide"

SEQ ID NO: 317 - protein, 10 aa, Artificial Sequence
  source: /note="Description of Artificial Sequence: Synthetic peptide"
GFTFSSYIMS

SEQ ID NO: 318 - protein, 10 aa, Artificial Sequence
  source: /note="Description of Artificial Sequence: Synthetic peptide"
TISGGGTNTY

SEQ ID NO: 319 - protein, 10 aa, Artificial Sequence
  source: /note="Description of Artificial Sequence: Synthetic peptide"
WLLSYYAMDY

SEQ ID NO: 320 - protein, 446 aa, Artificial Sequence; identical to SEQ ID NO: 300
  source: /note="Description of Artificial Sequence: Synthetic polypeptide"

SEQ ID NO: 321 - protein, 107 aa, Artificial Sequence
  source: /note="Description of Artificial Sequence: Synthetic polypeptide"
DIQMTQSPSSLSASVGDRITITCRASQNINVWLTWYQQKPGKAPKLLIYKASNLHTGVPSRFSGSGSGTDFTLTISSLQPEDFATYYCQQGQSYPYTFGQGTKLEIK

SEQ ID NO: 322 - protein, 11 aa, Artificial Sequence
  source: /note="Description of Artificial Sequence: Synthetic peptide"
RASQNINVWLT

SEQ ID NO: 323 - protein, 7 aa, Artificial Sequence
  source: /note="Description of Artificial Sequence: Synthetic peptide"
KASNLHT

SEQ ID NO: 324 - protein, 9 aa, Artificial Sequence
  source: /note="Description of Artificial Sequence: Synthetic peptide"
QQGQSYPYT

SEQ ID NO: 325 - protein, 214 aa, Artificial Sequence
  source: /note="Description of Artificial Sequence: Synthetic polypeptide"
DIQMTQSPSSLSASVGDRITITCRASQNINVWLTWYQQKPGKAPKLLIYKASNLHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 119 aa, Artificial Sequence; identical to SEQ ID NO: 306
  source: /note="Description of Artificial Sequence: Synthetic polypeptide"

SEQ ID NO: 327 - protein, 10 aa, Artificial Sequence
  source: /note="Description of Artificial Sequence: Synthetic peptide"
GFTFSSYIMS

SEQ ID NO: 328 - protein, 10 aa, Artificial Sequence
  source: /note="Description of Artificial Sequence: Synthetic peptide"
TISGGGTNTY

SEQ ID NO: 329 - protein, 10 aa, Artificial Sequence
  source: /note="Description of Artificial Sequence: Synthetic peptide"
WLLSYYAMDY

SEQ ID NO: 330 - protein, 446 aa, Artificial Sequence; identical to SEQ ID NO: 310
  source: /note="Description of Artificial Sequence: Synthetic polypeptide"

SEQ ID NO: 331 - protein, 107 aa, Artificial Sequence; identical to SEQ ID NO: 321
  source: /note="Description of Artificial Sequence: Synthetic polypeptide"

SEQ ID NO: 332 - protein, 11 aa, Artificial Sequence
  source: /note="Description of Artificial Sequence: Synthetic peptide"
RASQNINVWLT

SEQ ID NO: 333 - protein, 7 aa, Artificial Sequence
  source: /note="Description of Artificial Sequence: Synthetic peptide"
KASNLHT

SEQ ID NO: 334 - protein, 9 aa, Artificial Sequence
  source: /note="Description of Artificial Sequence: Synthetic peptide"
QQGQSYPYT

SEQ ID NO: 335 - protein, 214 aa, Artificial Sequence; identical to SEQ ID NO: 325
  source: /note="Description of Artificial Sequence: Synthetic polypeptide"

SEQ ID NO: 336 - protein, 119 aa, Artificial Sequence; identical to SEQ ID NO: 296
  source: /note="Description of Artificial Sequence: Synthetic polypeptide"

SEQ ID NO: 337 - protein, 10 aa, Artificial Sequence
  source: /note="Description of Artificial Sequence: Synthetic peptide"
GFTFSSYIMS

SEQ ID NO: 338 - protein, 10 aa, Artificial Sequence
  source: /note="Description of Artificial Sequence: Synthetic peptide"
TISGGGTNTY

SEQ ID NO: 339 - protein, 10 aa, Artificial Sequence
  source: /note="Description of Artificial Sequence: Synthetic peptide"
WLLSYYAMDY

SEQ ID NO: 340 - protein, 446 aa, Artificial Sequence; identical to SEQ ID NO: 300
  source: /note="Description of Artificial Sequence: Synthetic polypeptide"

SEQ ID NO: 341 - protein, 107 aa, Artificial Sequence
  source: /note="Description of Artificial Sequence: Synthetic polypeptide"
DIQMTQSPSSLSASVGDRVTITCRASQNINVWLTWYQQKPGKAPKLLIYKASKSHTGVPSRFSGSGSGTDFTLTISSLQPEDFATYYCQQGQSYPYTFGQGTKLEIK

SEQ ID NO: 342 - protein, 11 aa, Artificial Sequence
  source: /note="Description of Artificial Sequence: Synthetic peptide"
RASQNINVWLT

SEQ ID NO: 343 - protein, 7 aa, Artificial Sequence
  source: /note="Description of Artificial Sequence: Synthetic peptide"
KASKSHT

SEQ ID NO: 344 - protein, 9 aa, Artificial Sequence
  source: /note="Description of Artificial Sequence: Synthetic peptide"
QQGQSYPYT

SEQ ID NO: 345 - protein, 214 aa, Artificial Sequence
  source: /note="Description of Artificial Sequence: Synthetic polypeptide"
DIQMTQSPSSLSASVGDRVTITCRASQNINVWLTWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 346 - protein, 119 aa, Artificial Sequence; identical to SEQ ID NO: 306
  source: /note="Description of Artificial Sequence: Synthetic polypeptide"

SEQ ID NO: 347 - protein, 10 aa, Artificial Sequence
  source: /note="Description of Artificial Sequence: Synthetic peptide"
GFTFSSYIMS

SEQ ID NO: 348 - protein, 10 aa, Artificial Sequence
  source: /note="Description of Artificial Sequence: Synthetic peptide"
TISGGGTNTY

SEQ ID NO: 349 - protein, 10 aa, Artificial Sequence
  source: /note="Description of Artificial Sequence: Synthetic peptide"
WLLSYYAMDY

SEQ ID NO: 350 - protein, 446 aa, Artificial Sequence; identical to SEQ ID NO: 310
  source: /note="Description of Artificial Sequence: Synthetic polypeptide"

SEQ ID NO: 351 - protein, 107 aa, Artificial Sequence; identical to SEQ ID NO: 341
  source: /note="Description of Artificial Sequence: Synthetic polypeptide"

SEQ ID NO: 352 - protein, 11 aa, Artificial Sequence
  source: /note="Description of Artificial Sequence: Synthetic peptide"
RASQNINVWLT

SEQ ID NO: 353 - protein, 7 aa, Artificial Sequence
  source: /note="Description of Artificial Sequence: Synthetic peptide"
KASKSHT

SEQ ID NO: 354 - protein, 9 aa, Artificial Sequence
  source: /note="Description of Artificial Sequence: Synthetic peptide"
QQGQSYPYT

SEQ ID NO: 355 - protein, 214 aa, Artificial Sequence; identical to SEQ ID NO: 345
  source: /note="Description of Artificial Sequence: Synthetic polypeptide"

SEQ ID NO: 356 - protein, 119 aa, Artificial Sequence; identical to SEQ ID NO: 296
  source: /note="Description of Artificial Sequence: Synthetic polypeptide"

SEQ ID NO: 357 - protein, 10 aa, Artificial Sequence
  source: /note="Description of Artificial Sequence: Synthetic peptide"
GFTFSSYIMS

SEQ ID NO: 358 - protein, 10 aa, Artificial Sequence
  source: /note="Description of Artificial Sequence: Synthetic peptide"
TISGGGTNTY

SEQ ID NO: 359 - protein, 10 aa, Artificial Sequence
  source: /note="Description of Artificial Sequence: Synthetic peptide"
WLLSYYAMDY

SEQ ID NO: 360 - protein, 446 aa, Artificial Sequence; identical to SEQ ID NO: 300
  source: /note="Description of Artificial Sequence: Synthetic polypeptide"

SEQ ID NO: 361 - protein, 107 aa, Artificial Sequence
  source: /note="Description of Artificial Sequence: Synthetic polypeptide"
DIQMTQSPSSLSASVGDRITITCRASQNINVWLTWYQQKPGKAPKLLIYKASKSHTGVPSRFSGSGSGTDFTLTISSLQPEDFATYYCQQGQSYPYTFGQGTKLEIK

SEQ ID NO: 362 - protein, 11 aa, Artificial Sequence
  source: /note="Description of Artificial Sequence: Synthetic peptide"
RASQNINVWLT

SEQ ID NO: 363 - protein, 7 aa, Artificial Sequence
  source: /note="Description of Artificial Sequence: Synthetic peptide"
KASKSHT

SEQ ID NO: 364 - protein, 9 aa, Artificial Sequence
  source: /note="Description of Artificial Sequence: Synthetic peptide"
QQGQSYPYT

SEQ ID NO: 365 - protein, 214 aa, Artificial Sequence
  source: /note="Description of Artificial Sequence: Synthetic polypeptide"
DIQMTQSPSSLSASVGDRITITCRASQNINVWLTWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 366 - protein, 119 aa, Artificial Sequence; identical to SEQ ID NO: 306
  source: /note="Description of Artificial Sequence: Synthetic polypeptide"

SEQ ID NO: 367 - protein, 10 aa, Artificial Sequence
  source: /note="Description of Artificial Sequence: Synthetic peptide"
GFTFSSYIMS

SEQ ID NO: 368 - protein, 10 aa, Artificial Sequence
  source: /note="Description of Artificial Sequence: Synthetic peptide"
TISGGGTNTY

SEQ ID NO: 369 - protein, 10 aa, Artificial Sequence
  source: /note="Description of Artificial Sequence: Synthetic peptide"
WLLSYYAMDY

SEQ ID NO: 370 - protein, 446 aa, Artificial Sequence; identical to SEQ ID NO: 310
  source: /note="Description of Artificial Sequence: Synthetic polypeptide"

SEQ ID NO: 371 - protein, 107 aa, Artificial Sequence; identical to SEQ ID NO: 361
  source: /note="Description of Artificial Sequence: Synthetic polypeptide"

SEQ ID NO: 372 - protein, 11 aa, Artificial Sequence
  source: /note="Description of Artificial Sequence: Synthetic peptide"
RASQNINVWLT

SEQ ID NO: 373 - protein, 7 aa, Artificial Sequence
  source: /note="Description of Artificial Sequence: Synthetic peptide"
KASKSHT

SEQ ID NO: 374 - protein, 9 aa, Artificial Sequence
  source: /note="Description of Artificial Sequence: Synthetic peptide"
QQGQSYPYT

SEQ ID NO: 375 - protein, 214 aa, Artificial Sequence; identical to SEQ ID NO: 365
  source: /note="Description of Artificial Sequence: Synthetic polypeptide"

SEQ ID NO: 376 - protein, 119 aa, Artificial Sequence
  source: /note="Description of Artificial Sequence: Synthetic polypeptide"
QVQLVQSGAEVKKPGASVKVSCKASGYTITNYGMNWVRQAPGQGLEWMGWINTYTGEPTYAQKFQGRVTMTRDTSTSTVYMELSSLRSEDTAVYYCARGNGNPLGMDYWGQGTLVTVSS

SEQ ID NO: 377 - protein, 10 aa, Artificial Sequence
  source: /note="Description of Artificial Sequence: Synthetic peptide"
GYTITNYGMN

SEQ ID NO: 378 - protein, 10 aa, Artificial Sequence
  source: /note="Description of Artificial Sequence: Synthetic peptide"
WINTYTGEPT

SEQ ID NO: 379 - protein, 10 aa, Artificial Sequence
  source: /note="Description of Artificial Sequence: Synthetic peptide"
GNGNPLGMDY

SEQ ID NO: 380 - protein, 446 aa, Artificial Sequence
  source: /note="Description of Artificial Sequence: Synthetic polypeptide"
QVQLVQSGAEVKKPGASVKVSCKASGYTITNYGMNWVRQAPGQGLEWMGWINTYTGEPTYAQKFQGRVTMTRDTSTSTVYMELSSLRSEDTAVYYCARGNGNPLGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 381 - protein, 106 aa, Artificial Sequence
  source: /note="Description of Artificial Sequence: Synthetic polypeptide"
EIVLTQSPATLSLSPGERATLSCGNGNPLGMDYWYQQKPGQAPRLLIYDTSKLASGIPARFSGSGSGTDFTLTISSLEPEDFAVYYCFQGSGYPLTFGQGTKLEIK

SEQ ID NO: 382 - protein, 10 aa, Artificial Sequence
  source: /note="Description of Artificial Sequence: Synthetic peptide"
GNGNPLGMDY

SEQ ID NO: 383 - protein, 7 aa, Artificial Sequence
  source: /note="Description of Artificial Sequence: Synthetic peptide"
DTSKLAS

SEQ ID NO: 384 - protein, 9 aa, Artificial Sequence
  source: /note="Description of Artificial Sequence: Synthetic peptide"
FQGSGYPLT

SEQ ID NO: 385 - protein, 213 aa, Artificial Sequence
  source: /note="Description of Artificial Sequence: Synthetic polypeptide"
EIVLTQSPATLSLSPGERATLSCGNGNPLGMDYWYQQKPGQAPRLLIYDTSKLASGIPARFSGSGSGTDFTLTISSLEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 386 - protein, 119 aa, Artificial Sequence
  source: /note="Description of Artificial Sequence: Synthetic polypeptide"
QVQLVQSGAEVKKPGASVKVSCKASGYTITNYGMNWVRQAPGQGLEWMGWINTYTGEPTYAQKFQGRFTMTLDTSTSTVYMELSSLRSEDTAVYYCARGNGNPLGMDYWGQGTLVTVSS

SEQ ID NO: 387 - protein, 10 aa, Artificial Sequence
  source: /note="Description of Artificial Sequence: Synthetic peptide"
GYTITNYGMN

SEQ ID NO: 388 - protein, 10 aa, Artificial Sequence
  source: /note="Description of Artificial Sequence: Synthetic peptide"
WINTYTGEPT

SEQ ID NO: 389 - protein, 10 aa, Artificial Sequence
  source: /note="Description of Artificial Sequence: Synthetic peptide"
GNGNPLGMDY

SEQ ID NO: 390 - protein, 446 aa, Artificial Sequence
  source: /note="Description of Artificial Sequence: Synthetic polypeptide"
QVQLVQSGAEVKKPGASVKVSCKASGYTITNYGMNWVRQAPGQGLEWMGWINTYTGEPTYAQKFQGRFTMTLDTSTSTVYMELSSLRSEDTAVYYCARGNGNPLGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 391 - protein, 106 aa, Artificial Sequence
  source: /note="Description of Artificial Sequence: Synthetic polypeptide"
EIVLTQSPATLSLSPGERATLSCGNGNPLGMDYWYQQKPGQAPRLLIYDTSKLASGIPARFSGSGSGTDYTLTISSLEPEDFAVYYCFQGSGYPLTFGQGTKLEIK

SEQ ID NO: 392 - protein, 10 aa, Artificial Sequence
  source: /note="Description of Artificial Sequence: Synthetic peptide"
GNGNPLGMDY

SEQ ID NO: 393 - protein, 7 aa, Artificial Sequence
  source: /note="Description of Artificial Sequence: Synthetic peptide"
DTSKLAS

SEQ ID NO: 394 - protein, 9 aa, Artificial Sequence
  source: /note="Description of Artificial Sequence: Synthetic peptide"
FQGSGYPLT

SEQ ID NO: 395 - protein, 213 aa, Artificial Sequence
  source: /note="Description of Artificial Sequence: Synthetic polypeptide"
EIVLTQSPATLSLSPGERATLSCGNGNPLGMDYWYQQKPGQAPRLLIYDTSKLASGIPARFSGSGSGTDYTLTISSLEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 396 - protein, 119 aa, Artificial Sequence; identical to SEQ ID NO: 386
  source: /note="Description of Artificial Sequence: Synthetic polypeptide"

SEQ ID NO: 397 - protein, 10 aa, Artificial Sequence
  source: /note="Description of Artificial Sequence: Synthetic peptide"
GYTITNYGMN

SEQ ID NO: 398 - protein, 10 aa, Artificial Sequence
  source: /note="Description of Artificial Sequence: Synthetic peptide"
WINTYTGEPT

SEQ ID NO: 399 - protein, 10 aa, Artificial Sequence
  source: /note="Description of Artificial Sequence: Synthetic peptide"
GNGNPLGMDY

SEQ ID NO: 400 - protein, 446 aa, Artificial Sequence; identical to SEQ ID NO: 390
  source: /note="Description of Artificial Sequence: Synthetic polypeptide"

SEQ ID NO: 401 - protein, 106 aa, Artificial Sequence
  source: /note="Description of Artificial Sequence: Synthetic polypeptide"
EIVLTQSPATLSLSPGERATLSCGNGNPLGMDYWYQQKPGQAPRLWIYDTSKLASGVPARFSGSGSGTDYTLTISSLEPEDFAVYYCFQGSGYPLTFGQGTKLEIK

SEQ ID NO: 402 - protein, 10 aa, Artificial Sequence
  source: /note="Description of Artificial Sequence: Synthetic peptide"
GNGNPLGMDY

SEQ ID NO: 403 - protein, 7 aa, Artificial Sequence
  source: /note="Description of Artificial Sequence: Synthetic peptide"
DTSKLAS

SEQ ID NO: 404 - protein, 9 aa, Artificial Sequence
  source: /note="Description of Artificial Sequence: Synthetic peptide"
FQGSGYPLT

SEQ ID NO: 405 - protein, 213 aa, Artificial Sequence
  source: /note="Description of Artificial Sequence: Synthetic polypeptide"
EIVLTQSPATLSLSPGERATLSCGNGNPLGMDYWYQQKPGQAPRLWIYDTSKLASGVPARFSGSGSGTDYTLTISSLEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 119 aa, Artificial Sequence; identical to SEQ ID NO: 386
  source: /note="Description of Artificial Sequence: Synthetic polypeptide"

SEQ ID NO: 407 - protein, 10 aa, Artificial Sequence
  source: /note="Description of Artificial Sequence: Synthetic peptide"
GYTITNYGMN

SEQ ID NO: 408 - protein, 10 aa, Artificial Sequence
  source: /note="Description of Artificial Sequence: Synthetic peptide"
WINTYTGEPT

SEQ ID NO: 409 - protein, 10 aa, Artificial Sequence
  source: /note="Description of Artificial Sequence: Synthetic peptide"
GNGNPLGMDY

SEQ ID NO: 410 - protein, 446 aa, Artificial Sequence; identical to SEQ ID NO: 390
  source: /note="Description of Artificial Sequence: Synthetic polypeptide"

SEQ ID NO: 411 - protein, 106 aa, Artificial Sequence
  source: /note="Description of Artificial Sequence: Synthetic polypeptide"
EIVLTQSPATLSLSPGERVTMSCGNGNPLGMDYWYQQKPGQAPRLWIYDTSKLASGVPARFSGSGSGTDYTLTISSMEPEDFAVYYCFQGSGYPLTFGQGTKLEIK

SEQ ID NO: 412 - protein, 10 aa, Artificial Sequence
  source: /note="Description of Artificial Sequence: Synthetic peptide"
GNGNPLGMDY

SEQ ID NO: 413 - protein, 7 aa, Artificial Sequence
  source: /note="Description of Artificial Sequence: Synthetic peptide"
DTSKLAS

SEQ ID NO: 414 - protein, 9 aa, Artificial Sequence
  source: /note="Description of Artificial Sequence: Synthetic peptide"
FQGSGYPLT

SEQ ID NO: 415 - protein, 213 aa, Artificial Sequence
  source: /note="Description of Artificial Sequence: Synthetic polypeptide"
EIVLTQSPATLSLSPGERVTMSCGNGNPLGMDYWYQQKPGQAPRLWIYDTSKLASGVPARFSGSGSGTDYTLTISSMEPEDFAVYYCFQGSGYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 119 aa, Artificial Sequence
  source: /note="Description of Artificial Sequence: Synthetic polypeptide"
QVQLVQSGAEVKKPGASVKISCKASGYTITNYGMNWVRQAPGQGLEWMGWINTYTGEPTYAQKFQGRFTITLDTSTSTVYLEISSLRSEDTAVYYCARGNGNPLGMDYWGQGTLVTVSS

SEQ ID NO: 417 - protein, 10 aa, Artificial Sequence
  source: /note="Description of Artificial Sequence: Synthetic peptide"
GYTITNYGMN

SEQ ID NO: 418 - protein, 10 aa, Artificial Sequence
  source: /note="Description of Artificial Sequence: Synthetic peptide"
WINTYTGEPT

SEQ ID NO: 419 - protein, 10 aa, Artificial Sequence
  source: /note="Description of Artificial Sequence: Synthetic peptide"
GNGNPLGMDY

SEQ ID NO: 420 - protein, 446 aa, Artificial Sequence
  source: /note="Description of Artificial Sequence: Synthetic polypeptide"
QVQLVQSGAEVKKPGASVKISCKASGYTITNYGMNWVRQAPGQGLEWMGWINTYTGEPTYAQKFQGRFTITLDTSTSTVYLEISSLRSEDTAVYYCARGNGNPLGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 421 - protein, 106 aa, Artificial Sequence; identical to SEQ ID NO: 391
  source: /note="Description of Artificial Sequence: Synthetic polypeptide"

SEQ ID NO: 422 - protein, 10 aa, Artificial Sequence
  source: /note="Description of Artificial Sequence: Synthetic peptide"
GNGNPLGMDY

SEQ ID NO: 423 - protein, 7 aa, Artificial Sequence
  source: /note="Description of Artificial Sequence: Synthetic peptide"
DTSKLAS

SEQ ID NO: 424 - protein, 9 aa, Artificial Sequence
  source: /note="Description of Artificial Sequence: Synthetic peptide"
FQGSGYPLT

SEQ ID NO: 425 - protein, 213 aa, Artificial Sequence; identical to SEQ ID NO: 395
  source: /note="Description of Artificial Sequence: Synthetic polypeptide"

SEQ ID NO: 426 - protein, 119 aa, Artificial Sequence; identical to SEQ ID NO: 416
  source: /note="Description of Artificial Sequence: Synthetic polypeptide"

SEQ ID NO: 427 - protein, 10 aa, Artificial Sequence
  source: /note="Description of Artificial Sequence: Synthetic peptide"
GYTITNYGMN

SEQ ID NO: 428 - protein, 10 aa, Artificial Sequence
  source: /note="Description of Artificial Sequence: Synthetic peptide"
WINTYTGEPT

SEQ ID NO: 429 - protein, 10 aa, Artificial Sequence
  source: /note="Description of Artificial Sequence: Synthetic peptide"
GNGNPLGMDY

SEQ ID NO: 430 - protein, 446 aa, Artificial Sequence; identical to SEQ ID NO: 420
  source: /note="Description of Artificial Sequence: Synthetic polypeptide"

SEQ ID NO: 431 - protein, 106 aa, Artificial Sequence; identical to SEQ ID NO: 401
  source: /note="Description of Artificial Sequence: Synthetic polypeptide"

SEQ ID NO: 432 - protein, 10 aa, Artificial Sequence
  source: /note="Description of Artificial Sequence: Synthetic peptide"
GNGNPLGMDY

SEQ ID NO: 433 - protein, 7 aa, Artificial Sequence
  source: /note="Description of Artificial Sequence: Synthetic peptide"
DTSKLAS

SEQ ID NO: 434 - protein, 9 aa, Artificial Sequence
  source: /note="Description of Artificial Sequence: Synthetic peptide"
FQGSGYPLT

SEQ ID NO: 435 - protein, 213 aa, Artificial Sequence; identical to SEQ ID NO: 405
  source: /note="Description of Artificial Sequence: Synthetic polypeptide"

SEQ ID NO: 436 - protein, 119 aa, Artificial Sequence; identical to SEQ ID NO: 416
  source: /note="Description of Artificial Sequence: Synthetic polypeptide"

SEQ ID NO: 437 - protein, 10 aa, Artificial Sequence
  source: /note="Description of Artificial Sequence: Synthetic peptide"
GYTITNYGMN

SEQ ID NO: 438 - protein, 10 aa, Artificial Sequence
  source: /note="Description of Artificial Sequence: Synthetic peptide"
WINTYTGEPT

SEQ ID NO: 439 - protein, 10 aa, Artificial Sequence
  source: /note="Description of Artificial Sequence: Synthetic peptide"
GNGNPLGMDY

SEQ ID NO: 440 - protein, 446 aa, Artificial Sequence; identical to SEQ ID NO: 420
  source: /note="Description of Artificial Sequence: Synthetic polypeptide"

SEQ ID NO: 441 - protein, 106 aa, Artificial Sequence; identical to SEQ ID NO: 411
  source: /note="Description of Artificial Sequence: Synthetic polypeptide"

SEQ ID NO: 442 - protein, 10 aa, Artificial Sequence
  source: /note="Description of Artificial Sequence: Synthetic peptide"
GNGNPLGMDY

SEQ ID NO: 443 - protein, 7 aa, Artificial Sequence
  source: /note="Description of Artificial Sequence: Synthetic peptide"
DTSKLAS

SEQ ID NO: 444 - protein, 9 aa, Artificial Sequence
  source: /note="Description of Artificial Sequence: Synthetic peptide"
FQGSGYPLT

SEQ ID NO: 445 - protein, 213 aa, Artificial Sequence; identical to SEQ ID NO: 415
  source: /note="Description of Artificial Sequence: Synthetic polypeptide"

SEQ ID NO: 446 - protein, 119 aa, Artificial Sequence; identical to SEQ ID NO: 296
  source: /note="Description of Artificial Sequence: Synthetic polypeptide"

SEQ ID NO: 447 - protein, 10 aa, Artificial Sequence
  source: /note="Description of Artificial Sequence: Synthetic peptide"
GFTFSSYIMS

SEQ ID NO: 448 - protein, 10 aa, Artificial Sequence
  source: /note="Description of Artificial Sequence: Synthetic peptide"
TISGGGTNTY

SEQ ID NO: 449 - protein, 10 aa, Artificial Sequence
  source: /note="Description of Artificial Sequence: Synthetic peptide"
WLLSYYAMDY

SEQ ID NO: 450 - protein, 446 aa, Artificial Sequence; identical to SEQ ID NO: 300
  source: /note="Description of Artificial Sequence: Synthetic polypeptide"

SEQ ID NO: 451 - protein, 107 aa, Artificial Sequence
  source: /note="Description of Artificial Sequence: Synthetic polypeptide"
DIQMTQSPSSLSASVGDRVTITCRASQNINVWLSWYQQKPGKAPKLLIYKASKSHTGVPSRFSGSGSGTDFTLTISSLQPEDFATYYCQQGQSYPYTFGQGTKLEIK

SEQ ID NO: 452 - protein, 11 aa, Artificial Sequence
  source: /note="Description of Artificial Sequence: Synthetic peptide"
RASQNINVWLS

SEQ ID NO: 453 - protein, 7 aa, Artificial Sequence
  source: /note="Description of Artificial Sequence: Synthetic peptide"
KASKSHT

SEQ ID NO: 454 - protein, 9 aa, Artificial Sequence
  source: /note="Description of Artificial Sequence: Synthetic peptide"
QQGQSYPYT

SEQ ID NO: 455 - protein, 214 aa, Artificial Sequence
  source: /note="Description of Artificial Sequence: Synthetic polypeptide"
DIQMTQSPSSLSASVGDRVTITCRASQNINVWLSWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - protein, 119 aa, Artificial Sequence; identical to SEQ ID NO: 296
  source: /note="Description of Artificial Sequence: Synthetic polypeptide"

SEQ ID NO: 457 - protein, 10 aa, Artificial Sequence
  source: /note="Description of Artificial Sequence: Synthetic peptide"
GFTFSSYIMS

SEQ ID NO: 458 - protein, 10 aa, Artificial Sequence
  source: /note="Description of Artificial Sequence: Synthetic peptide"
TISGGGTNTY

SEQ ID NO: 459 - protein, 10 aa, Artificial Sequence
  source: /note="Description of Artificial Sequence: Synthetic peptide"
WLLSYYAMDY

SEQ ID NO: 460 - protein, 446 aa, Artificial Sequence; identical to SEQ ID NO: 300
  source: /note="Description of Artificial Sequence: Synthetic polypeptide"

SEQ ID NO: 461 - protein, 107 aa, Artificial Sequence
  source: /note="Description of Artificial Sequence: Synthetic polypeptide"
DIQMTQSPSSLSASVGDRITITCRASQNINVWLSWYQQKPGKAPKLLIYKASKSHTGVPSRFSGSGSGTDFTLTISSLQPEDFATYYCQQGQSYPYTFGQGTKLEIK

SEQ ID NO: 462 - protein, 11 aa, Artificial Sequence
  source: /note="Description of Artificial Sequence: Synthetic peptide"
RASQNINVWLS

SEQ ID NO: 463 - protein, 7 aa, Artificial Sequence
  source: /note="Description of Artificial Sequence: Synthetic peptide"
KASKSHT

SEQ ID NO: 464 - protein, 9 aa, Artificial Sequence
  source: /note="Description of Artificial Sequence: Synthetic peptide"
QQGQSYPYT

SEQ ID NO: 465 - protein, 214 aa, Artificial Sequence
  source: /note="Description of Artificial Sequence: Synthetic polypeptide"
DIQMTQSPSSLSASVGDRITITCRASQNINVWLSWYQQKPGKAPKLLIYKASKSHTGVPSRFSGSGSGTDFTLTISSLQPEDFATYYCQQGQSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 119 aa, Artificial Sequence; identical to SEQ ID NO: 306
  source: /note="Description of Artificial Sequence: Synthetic polypeptide"

SEQ ID NO: 467 - protein, 10 aa, Artificial Sequence
  source: /note="Description of Artificial Sequence: Synthetic peptide"
GFTFSSYIMS

SEQ ID NO: 468 - protein, 10 aa, Artificial Sequence
  source: /note="Description of Artificial Sequence: Synthetic peptide"
TISGGGTNTY

SEQ ID NO: 469 - protein, 10 aa, Artificial Sequence
  source: /note="Description of Artificial Sequence: Synthetic peptide"
WLLSYYAMDY

SEQ ID NO: 470 - protein, 446 aa, Artificial Sequence; identical to SEQ ID NO: 310
  source: /note="Description of Artificial Sequence: Synthetic polypeptide"

SEQ ID NO: 471 - protein, 107 aa, Artificial Sequence; identical to SEQ ID NO: 451
  source: /note="Description of Artificial Sequence: Synthetic polypeptide"

SEQ ID NO: 472 - protein, 11 aa, Artificial Sequence
  source: /note="Description of Artificial Sequence: Synthetic peptide"
RASQNINVWLS

SEQ ID NO: 473 - protein, 7 aa, Artificial Sequence
  source: /note="Description of Artificial Sequence: Synthetic peptide"
KASKSHT

SEQ ID NO: 474 - protein, 9 aa, Artificial Sequence
  source: /note="Description of Artificial Sequence: Synthetic peptide"
QQGQSYPYT

SEQ ID NO: 475 - protein, 214 aa, Artificial Sequence; identical to SEQ ID NO: 455
  source: /note="Description of Artificial Sequence: Synthetic polypeptide"

SEQ ID NO: 476 - protein, 119 aa, Artificial Sequence; identical to SEQ ID NO: 306
  source: /note="Description of Artificial Sequence: Synthetic polypeptide"

SEQ ID NO: 477 - protein, 10 aa, Artificial Sequence
  source: /note="Description of Artificial Sequence: Synthetic peptide"
GFTFSSYIMS

SEQ ID NO: 478 - protein, 10 aa, Artificial Sequence
  source: /note="Description of Artificial Sequence: Synthetic peptide"
TISGGGTNTY

SEQ ID NO: 479 - protein, 10 aa, Artificial Sequence
  source: /note="Description of Artificial Sequence: Synthetic peptide"
WLLSYYAMDY

SEQ ID NO: 480 - protein, 446 aa, Artificial Sequence; identical to SEQ ID NO: 310
  source: /note="Description of Artificial Sequence: Synthetic polypeptide"

SEQ ID NO: 481 - protein, 107 aa, Artificial Sequence; identical to SEQ ID NO: 461
  source: /note="Description of Artificial Sequence: Synthetic polypeptide"

SEQ ID NO: 482 - protein, 11 aa, Artificial Sequence
  source: /note="Description of Artificial Sequence: Synthetic peptide"
RASQNINVWLS

SEQ ID NO: 483 - protein, 7 aa, Artificial Sequence
  source: /note="Description of Artificial Sequence: Synthetic peptide"
KASKSHT

SEQ ID NO: 484 - protein, 9 aa, Artificial Sequence
  source: /note="Description of Artificial Sequence: Synthetic peptide"
QQGQSYPYT

SEQ ID NO: 485 - protein, 214 aa, Artificial Sequence; identical to SEQ ID NO: 465
  source: /note="Description of Artificial Sequence: Synthetic polypeptide"

SEQ ID NO: 486 - protein, 117 aa, Artificial Sequence
  source: /note="Description of Artificial Sequence: Synthetic polypeptide"
EVQLQQSGPELVKPGASMKISCKASGYSFTGYTMNWVRQSHGKNLEWLGLIFPYNGGTSYNQNFKGKATLTVDTSSSTAYMELLSLTSVDSAVYYCARGVRFALDYWGQGTSVSVSS

SEQ ID NO: 487 - protein, 10 aa, Artificial Sequence
  source: /note="Description of Artificial Sequence: Synthetic peptide"
GYSFTGYTMN

SEQ ID NO: 488 - protein, 10 aa, Artificial Sequence
  source: /note="Description of Artificial Sequence: Synthetic peptide"
LIFPYNGGTS

SEQ ID NO: 489 - protein, 8 aa, Artificial Sequence
  source: /note="Description of Artificial Sequence: Synthetic peptide"
GVRFALDY

SEQ ID NO: 490 - protein, 112 aa, Artificial Sequence
  source: /note="Description of Artificial Sequence: Synthetic polypeptide"
DVVMTQTPLSLPVSFGDQVSISCRSSQSLANSYGNTYLSWYLHKPGQSPQLLIYEISNRFSGVPDRFSGSGSGTDFTLNISTIKPEDLGMYYCLQGTHQPWTFGGGTKLEIK

SEQ ID NO: 491 - protein, 16 aa, Artificial Sequence
  source: /note="Description of Artificial Sequence: Synthetic peptide"
RSSQSLANSYGNTYLS

SEQ ID NO: 492 - protein, 7 aa, Artificial Sequence
  source: /note="Description of Artificial Sequence: Synthetic peptide"
EISNRFS

SEQ ID NO: 493 - protein, 9 aa, Artificial Sequence
  source: /note="Description of Artificial Sequence: Synthetic peptide"
LQGTHQPWT

SEQ ID NO: 494 - protein, 119 aa, Artificial Sequence; identical to SEQ ID NO: 126
  source: /note="Description of Artificial Sequence: Synthetic polypeptide"

SEQ ID NO: 495 - protein, 8 aa, Artificial Sequence
  source: /note="Description of Artificial Sequence: Synthetic peptide"
GYTFSSYV

SEQ ID NO: 496 - protein, 8 aa, Artificial Sequence
  source: /note="Description of Artificial Sequence: Synthetic peptide"
IDPYNDGA

SEQ ID NO: 497 - protein, 12 aa, Artificial Sequence
  source: /note="Description of Artificial Sequence: Synthetic peptide"
ARGGPYGWYFDV

SEQ ID NO: 498 - protein, 443 aa, Artificial Sequence
  source: /note="Description of Artificial Sequence: Synthetic polypeptide"
EVQLQQSGPELVKPGSSVKMSCKASGYTFSSYVMHWVKQKPGQGLEWIGYIDPYNDGAKYNEKFKGKATLTSDKSSSTAYMELSSLTSEDSAVYYCARGGPYGWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 499 - protein, 107 aa, Artificial Sequence; identical to SEQ ID NO: 131
  source: /note="Description of Artificial Sequence: Synthetic polypeptide"

SEQ ID NO: 500 - protein, 6 aa, Artificial Sequence
  source: /note="Description of Artificial Sequence: Synthetic peptide"
EHIYSY

SEQ ID NO: 501 - protein, 3 aa, Artificial Sequence
  source: /note="Description of Artificial Sequence: Synthetic peptide"
NAK

SEQ ID NO: 502 - protein, 9 aa, Artificial Sequence
  source: /note="Description of Artificial Sequence: Synthetic peptide"
QHHFGSPLT

SEQ ID NO: 503 - protein, 214 aa, Artificial Sequence
  source: /note="Description of Artificial Sequence: Synthetic polypeptide"
DIQMTQSPASLSASVGETVTITCRASEHIYSYLSWYQQKQGKSPQLLVYNAKTLAEGVPSRFSGSGSGTQFSLKINSLQPEDFGTYYCQHHFGSPLTFGAGTTLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 504 - protein, 130 aa, Artificial Sequence; identical to SEQ ID NO: 136
  source: /note="Description of Artificial Sequence: Synthetic polypeptide"

SEQ ID NO: 505 - protein, 10 aa, Artificial Sequence
  source: /note="Description of Artificial Sequence: Synthetic peptide"
GGSVSSGIYY

SEQ ID NO: 506 - protein, 7 aa, Artificial Sequence
  source: /note="Description of Artificial Sequence: Synthetic peptide"
IYYSGST

SEQ ID NO: 507 - protein, 22 aa, Artificial Sequence
  source: /note="Description of Artificial Sequence: Synthetic peptide"
ARDYYVSGNYYNVDYYFFGVDV

SEQ ID NO: 508 - protein, 454 aa, Artificial Sequence
  source: /note="Description of Artificial Sequence: Synthetic polypeptide"
QVHLQESGPGLVKPSETLSLTCTVSGGSVSSGIYYWSWIRQPPGKGLEWIGYIYYSGSTNYNPSLKSRVTISVDTSKNQFSLKLSSVTAADTAVYYCARDYYVSGNYYNVDYYFFGVDVWGQGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 509 - protein, 109 aa, Artificial Sequence; identical to SEQ ID NO: 141
  source: /note="Description of Artificial Sequence: Synthetic polypeptide"

SEQ ID NO: 510 - protein, 6 aa, Artificial Sequence
  source: /note="Description of Artificial Sequence: Synthetic peptide"
QSVSSY

SEQ ID NO: 511 - protein, 3 aa, Artificial Sequence
  source: /note="Description of Artificial Sequence: Synthetic peptide"
DAS

SEQ ID NO: 512 - protein, 11 aa, Artificial Sequence
  source: /note="Description of Artificial Sequence: Synthetic peptide"
QQRSNWPPLFT

SEQ ID NO: 513 - protein, 216 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLFTFGPGTKVDIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 514 - protein, 119 aa, Artificial Sequence
  source: /note="Description of Artificial Sequence: Synthetic polypeptide"
DVQLVESGGGLVQPGGSRKLSCAASGFTFSNFGMHWVRQAPEKGLEWVAFISSGSSSIYYADTVKGRFTISRDNPKNTLFLQMTSLRSEDTAMYYCARMRLDYYAMDYWGQGTSVTVSS

SEQ ID NO: 515 - protein, 5 aa, Artificial Sequence
  source: /note="Description of Artificial Sequence: Synthetic peptide"
NFGMH

SEQ ID NO: 516 - protein, 17 aa, Artificial Sequence
  source: /note="Description of Artificial Sequence: Synthetic peptide"
FISSGSSSIYYADTVKG

SEQ ID NO: 517 - protein, 10 aa, Artificial Sequence
  source: /note="Description of Artificial Sequence: Synthetic peptide"
MRLDYYAMDY

SEQ ID NO: 518 - protein, 107 aa, Artificial Sequence
  source: /note="Description of Artificial Sequence: Synthetic polypeptide"
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIK

SEQ ID NO: 519 - protein, 11 aa, Artificial Sequence
  source: /note="Description of Artificial Sequence: Synthetic peptide"
RASKSISKYLA

SEQ ID NO: 520 - protein, 7 aa, Artificial Sequence
  source: /note="Description of Artificial Sequence: Synthetic peptide"
SGSTLQS

SEQ ID NO: 521 - protein, 9 aa, Artificial Sequence
  source: /note="Description of Artificial Sequence: Synthetic peptide"
QQHNEYPWT

SEQ ID NO: 522 - protein, 119 aa, Artificial Sequence
  source: /note="Description of Artificial Sequence: Synthetic polypeptide"
EVQLQQSGPELVKPGASVKISCKTSGYTFTEYTMHWVKQSHGKNLEWIGGINPNNGGTSYNQKFKGRATLTVDKSSSTAYMELRSLTSDDSAVYYCARPGWYNYAMDYWGQGTSVTVSS

SEQ ID NO: 523 - protein, 5 aa, Artificial Sequence
  source: /note="Description of Artificial Sequence: Synthetic peptide"
EYTMH

SEQ ID NO: 524 - protein, 17 aa, Artificial Sequence
  source: /note="Description of Artificial Sequence: Synthetic peptide"
GINPNNGGTSYNQKFKG

SEQ ID NO: 525 - protein, 10 aa, Artificial Sequence
  source: /note="Description of Artificial Sequence: Synthetic peptide"
PGWYNYAMDY

SEQ ID NO: 526 - protein, 107 aa, Artificial Sequence
  source: /note="Description of Artificial Sequence: Synthetic polypeptide"
DIVMTQSHKFMSTSVGDRVNITCKASQGVSTAVAWYQQKPGQSPKLLIYSASYRYTGVPDRFTGSGSGTDFTFTISSVQAEDLAVYHCQQHYITPWTFGGGTKLEIK

SEQ ID NO: 527 - protein, 11 aa, Artificial Sequence
  source: /note="Description of Artificial Sequence: Synthetic peptide"
KASQGVSTAVA

SEQ ID NO: 528 - protein, 7 aa, Artificial Sequence
  source: /note="Description of Artificial Sequence: Synthetic peptide"
SASYRYT

SEQ ID NO: 529 - protein, 9 aa, Artificial Sequence
  source: /note="Description of Artificial Sequence: Synthetic peptide"
QQHYITPWT

SEQ ID NO: 530 - protein, 119 aa, Artificial Sequence
  source: /note="Description of Artificial Sequence: Synthetic polypeptide"
EVQLVESGGGLVKPGGSLKLSCAASGFAFSDYDMSWVRQTPEKRLEWVAYISDGGYNTYYPDTVKGRFTISRDNAKNTLYLQMSSLKSEDTAIYYCARQILLRYYFDYWGQGTTLTVSS

SEQ ID NO: 531 - protein, 5 aa, Artificial Sequence
  source: /note="Description of Artificial Sequence: Synthetic peptide"
DYDMS

SEQ ID NO: 532 - protein, 17 aa, Artificial Sequence
  source: /note="Description of Artificial Sequence: Synthetic peptide"
YISDGGYNTYYPDTVKG

SEQ ID NO: 533 - protein, 10 aa, Artificial Sequence
  source: /note="Description of Artificial Sequence: Synthetic peptide"
QILLRYYFDY

SEQ ID NO: 534 - protein, 113 aa, Artificial Sequence
  source: /note="Description of Artificial Sequence: Synthetic polypeptide"
DIVMSQSPSSLAVSVGEKVTMTCKSSQSLLYSSNQKNYLAWYQQKPGQSPKLLIYWASTRESGVPDRFTGSGSGTDFTLTISSVKAEDLAVYYCQQYHSYPWTFGGGTKLEIK

SEQ ID NO: 535 - protein, 17 aa, Artificial Sequence
  source: /note="Description of Artificial Sequence: Synthetic peptide"
KSSQSLLYSSNQKNYLA

SEQ ID NO: 536 - protein, 7 aa, Artificial Sequence
  source: /note="Description of Artificial Sequence: Synthetic peptide"
WASTRES

SEQ ID NO: 537 - protein, 9 aa, Artificial Sequence
  source: /note="Description of Artificial Sequence: Synthetic peptide"
QQYHSYPWT

SEQ ID NO: 538 - protein, 119 aa, Artificial Sequence
  source: /note="Description of Artificial Sequence: Synthetic polypeptide"
EVQLVESGGGLVQPGGSLRLSCAASGFTFSNFGMHWVRQAPGKGLEWVAFISSGSSSIYYADTVKGRFTISRDNAKNSLYLQMNSLRAEDTAVYYCARMRLDYYAMDYWGQGTMVTVSS

SEQ ID NO: 539 - protein, 107 aa, Artificial Sequence
  source: /note="Description of Artificial Sequence: Synthetic polypeptide"
DIQMTQSPSSLSASVGDRVTITCRASKSISKYLAWYQQKPGKAPKLLIYSGSTLQSGVPSRFSGSGSGTDFTLTISSLQPEDFATYYCQQHNEYPWTFGGGTKVEIK

SEQ ID NO: 540 - protein, 138 aa, Artificial Sequence
  source: /note="Description of Artificial Sequence: Synthetic polypeptide"
MDSRLNLVFLVLILKGVQCEVQLVESGGGLVQPGGSLRLSCAASGFTFSNFGMHWVRQAPGKGLEWVAFISSGSSSIYYADTVKGRFTISRDNAKNSLYLQMNSLRAEDTAVYYCARMRLDYYAMDYWGQGTMVTVSS

SEQ ID NO: 541 - protein, 127 aa, Artificial Sequence
  source: /note="Description of Artificial Sequence: Synthetic polypeptide"
MRFQVQVLGLLLLWISGAQCDIQMTQSPSSLSASVGDRVTITCRASKSISKYLAWYQQKPGKAPKLLIYSGSTLQSGVPSRFSGSGSGTDFTLTISSLQPEDFATYYCQQHNEYPWTFGGGTKVEIK

SEQ ID NO: 542 - protein, 119 aa, Artificial Sequence
  source: /note="Description of Artificial Sequence: Synthetic polypeptide"
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSS

SEQ ID NO: 543 - protein, 10 aa, Artificial Sequence
  source: /note="Description of Artificial Sequence: Synthetic peptide"
GFTFSSFTMH

SEQ ID NO: 544 - protein, 17 aa, Artificial Sequence
  source: /note="Description of Artificial Sequence: Synthetic peptide"
FIRSGSGIVFYADAVRG

SEQ ID NO: 545 - protein, 10 aa, Artificial Sequence
  source: /note="Description of Artificial Sequence: Synthetic peptide"
RPLGHNTFDS

SEQ ID NO: 546 - protein, 114 aa, Artificial Sequence
  source: /note="Description of Artificial Sequence: Synthetic polypeptide"
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKR

SEQ ID NO: 547 - protein, 17 aa, Artificial Sequence
  source: /note="Description of Artificial Sequence: Synthetic peptide"
KSSQSLYYSGVKENLLA

SEQ ID NO: 548 - protein, 6 aa, Artificial Sequence
  source: /note="Description of Artificial Sequence: Synthetic peptide"
ASIRFT

SEQ ID NO: 549 - protein, 9 aa, Artificial Sequence
  source: /note="Description of Artificial Sequence: Synthetic peptide"
QQGINNPLT

SEQ ID NO: 550 - protein, 119 aa, Artificial Sequence
  source: /note="Description of Artificial Sequence: Synthetic polypeptide"
EVQLQQSGPELVKPGTSMKISCKASGYSFTGHLMNWVKQSHGKNLEWIGLIIPYNGGTSYNQKFKGKATLTVDKSSSTAYMELLSLTSDDSAVYFCSRGLRGFYAMDYWGQGTSVTVSS

SEQ ID NO: 551 - protein, 10 aa, Artificial Sequence
  source: /note="Description of Artificial Sequence: Synthetic peptide"
GYSFTGHLMN

SEQ ID NO: 552 - protein, 17 aa, Artificial Sequence
  source: /note="Description of Artificial Sequence: Synthetic peptide"
LIIPYNGGTSYNQKFKG

SEQ ID NO: 553 - protein, 10 aa, Artificial Sequence
  source: /note="Description of Artificial Sequence: Synthetic peptide"
GLRGFYAMDY

SEQ ID NO: 554 - protein, 112 aa, Artificial Sequence
  source: /note="Description of Artificial Sequence: Synthetic polypeptide"
DVVLTQTPLSLSVSFGDQVSISCRSSQSLVNSYGNTFLSWYLHKPGQSPQLLIFGISNRFSGVPDRFSGSGSGTDFTLKISTIKPEDLGMYYCLQGTHQPPTFGPGTKLEVK

SEQ ID NO: 555 - protein, 16 aa, Artificial Sequence
  source: /note="Description of Artificial Sequence: Synthetic peptide"
RSSQSLVNSYGNTFLS

SEQ ID NO: 556 - protein, 7 aa, Artificial Sequence
  source: /note="Description of Artificial Sequence: Synthetic peptide"
GISNRFS

SEQ ID NO: 557 - protein, 9 aa, Artificial Sequence
  source: /note="Description of Artificial Sequence: Synthetic peptide"
LQGTHQPPT

SEQ ID NO: 558 - protein, 11 aa, Artificial Sequence
  source: /note="Description of Artificial Sequence: Synthetic peptide"
GSITSSSYYWG

SEQ ID NO: 559 - protein, 11 aa, Artificial Sequence
  source: /note="Description of Artificial Sequence: Synthetic peptide"
GSISSSKYYWG

SEQ ID NO: 560 - protein, 11 aa, Artificial Sequence
  source: /note="Description of Artificial Sequence: Synthetic peptide"
GSISSTSHYWG

SEQ ID NO: 561 - protein, 11 aa, Artificial Sequence
  source: /note="Description of Artificial Sequence: Synthetic peptide"
GSISSTSHYWG

SEQ ID NO: 562 - protein, 11 aa, Artificial Sequence
  source: /note="Description of Artificial Sequence: Synthetic peptide"
GSISSTSHYWG

SEQ ID NO: 563 - protein, 16 aa, Artificial Sequence
  source: /note="Description of Artificial Sequence: Synthetic peptide"
SIYYSGATFYNPSLKS

SEQ ID NO: 564 - protein, 16 aa, Artificial Sequence
  source: /note="Description of Artificial Sequence: Synthetic peptide"
SIYYSGSTFYNPSLKS

SEQ ID NO: 565 - protein, 16 aa, Artificial Sequence
  source: /note="Description of Artificial Sequence: Synthetic peptide"
SIYYSGSTFYNPSLKS

SEQ ID NO: 566 - protein, 16 aa, Artificial Sequence
  source: /note="Description of Artificial Sequence: Synthetic peptide"
SIYYSGSTFYNPSLKS

SEQ ID NO: 567 - protein, 16 aa, Artificial Sequence
  source: /note="Description of Artificial Sequence: Synthetic peptide"
SIYYSGSTFYNPSLKG

SEQ ID NO: 568 - protein, 15 aa, Artificial Sequence
  source: /note="Description of Artificial Sequence: Synthetic peptide"
ARDANYYGSAWAFDP

SEQ ID NO: 569 - protein, 15 aa, Artificial Sequence
  source: /note="Description of Artificial Sequence: Synthetic peptide"
ARDANYYGSAWAFDP

SEQ ID NO: 570 - protein, 15 aa, Artificial Sequence
  source: /note="Description of Artificial Sequence: Synthetic peptide"
ARDANYYGSAWAFDP

SEQ ID NO: 571 - protein, 15 aa, Artificial Sequence
  source: /note="Description of Artificial Sequence: Synthetic peptide"
ARDANYYGGAWAFDP

SEQ ID NO: 572 - protein, 15 aa, Artificial Sequence
  source: /note="Description of Artificial Sequence: Synthetic peptide"
ARDANYYGSAWAFDP

SEQ ID NO: 573 - protein, 123 aa, Artificial Sequence
  source: /note="Description of Artificial Sequence: Synthetic polypeptide"
QLQLQESGPGLVKPSETLSLTCTVSGGSITSSSYYWGWIRQPPGKGLEWIGSIYYSGATFYNPSLKSRVTISVDTSKNQFSLKLSSVTAADTAVYYCARDANYYGSAWAFDPWGQGTLVTVSS

SEQ ID NO: 574 - protein, 123 aa, Artificial Sequence
  source: /note="Description of Artificial Sequence: Synthetic polypeptide"
QLQLQESGPGLVKPSETLSLTCTVSGGSISSSKYYWGWIRQPPGKGLEWIGSIYYSGSTFYNPSLKSRVTISVDTSKNQFSLKLSSVTAADTAVYYCARDANYYGSAWAFDPWGQGTLVTVSS

SEQ ID NO: 575 - protein, 123 aa, Artificial Sequence
  source: /note="Description of Artificial Sequence: Synthetic polypeptide"
QLQLQESGPGLVKPSETLSLTCTVSGGSISSTSHYWGWIRQPPGKGLEWIGSIYYSGSTFYNPSLKSRVTISVDTSKNQFSLKLSSVTAADTAVYYCARDANYYGSAWAFDPWGQGTLVTVSS

SEQ ID NO: 576 - protein, 123 aa, Artificial Sequence
  source: /note="Description of Artificial Sequence: Synthetic polypeptide"
QLQLQESGPGLVKPSETLSLTCTVSGGSISSTSHYWGWIRQPPGKGLEWIGSIYYSGSTFYNPSLKSRVTISVDTSKNQFSLKLSSVTAADTAVYYCARDANYYGGAWAFDPWGQGTLVTVSS

SEQ ID NO: 577 - protein, 123 aa, Artificial Sequence
  source: /note="Description of Artificial Sequence: Synthetic polypeptide"
QLQLQESGPGLVKPSETLSLTCTVSGGSISSTSHYWGWIRQPPGKGLEWIGSIYYSGSTFYNPSLKGRVTISVDTSKNQFSLKLSSVTAADTAVYYCARDANYYGSAWAFDPWGQGTLVTVSS

SEQ ID NO: 578 - protein, 11 aa, Artificial Sequence
  source: /note="Description of Artificial Sequence: Synthetic peptide"
RASQSVSSYLA

SEQ ID NO: 579 - protein, 11 aa, Artificial Sequence
  source: /note="Description of Artificial Sequence: Synthetic peptide"
RASQSVSSYLA

SEQ ID NO: 580 - protein, 11 aa, Artificial Sequence
  source: /note="Description of Artificial Sequence: Synthetic peptide"
RASQSVSSYLA

SEQ ID NO: 581 - protein, 11 aa, Artificial Sequence
  source: /note="Description of Artificial Sequence: Synthetic peptide"
RASQSVSSYLA

SEQ ID NO: 582 - protein, 11 aa, Artificial Sequence
  source: /note="Description of Artificial Sequence: Synthetic peptide"
RASQSVSSYLA

SEQ ID NO: 583 - protein, 7 aa, Artificial Sequence
  source: /note="Description of Artificial Sequence: Synthetic peptide"
DASNRAT

SEQ ID NO: 584 - protein, 7 aa, Artificial Sequence
  source: /note="Description of Artificial Sequence: Synthetic peptide"
DASNRAT

SEQ ID NO: 585 - protein, 7 aa, Artificial Sequence
  source: /note="Description of Artificial Sequence: Synthetic peptide"
DASNRAT

SEQ ID NO: 586 - protein, 7 aa, Artificial Sequence
  source: /note="Description of Artificial Sequence: Synthetic peptide"
DASNRAT

SEQ ID NO: 587 - protein, 7 aa, Artificial Sequence
  source: /note="Description of Artificial Sequence: Synthetic peptide"
DASNRAT

SEQ ID NO: 588 - protein, 8 aa, Artificial Sequence
  source: /note="Description of Artificial Sequence: Synthetic peptide"
QQHFNLPT

SEQ ID NO: 589 - protein, 8 aa, Artificial Sequence
  source: /note="Description of Artificial Sequence: Synthetic peptide"
QQHFNLPT

SEQ ID NO: 590 - protein, 8 aa, Artificial Sequence
  source: /note="Description of Artificial Sequence: Synthetic peptide"
QQHFNLPT

SEQ ID NO: 591 - protein, 8 aa, Artificial Sequence
  source: /note="Description of Artificial Sequence: Synthetic peptide"
QQHFNLPT

SEQ ID NO: 592 - protein, 8 aa, Artificial Sequence
  source: /note="Description of Artificial Sequence: Synthetic peptide"
QQHFNLPT

SEQ ID NO: 593 - protein, 106 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQHFNLPTFGGGTKVEIK

SEQ ID NO: 594 - protein, 106 aa, Artificial Sequence; identical to SEQ ID NO: 593
  source: /note="Description of Artificial Sequence: Synthetic polypeptide"

SEQ ID NO: 595 - protein, 106 aa, Artificial Sequence; identical to SEQ ID NO: 593
  source: /note="Description of Artificial Sequence: Synthetic polypeptide"

SEQ ID NO: 596 - protein, 106 aa, Artificial Sequence; identical to SEQ ID NO: 593
  source: /note="Description of Artificial Sequence: Synthetic polypeptide"

SEQ ID NO: 597 - protein, 106 aa, Artificial Sequence; identical to SEQ ID NO: 593
  source: /note="Description of Artificial Sequence: Synthetic polypeptide"

SEQ ID NO: 598 - protein, 11 aa, Artificial Sequence
  source: /note="Description of Artificial Sequence: Synthetic peptide"
GSIESGSYYWG

SEQ ID NO: 599 - protein, 11 aa, Artificial Sequence
  source: /note="Description of Artificial Sequence: Synthetic peptide"
GSIESGVYYWG

SEQ ID NO: 600 - protein, 11 aa, Artificial Sequence
  source: /note="Description of Artificial Sequence: Synthetic peptide"
GSIASGSYYWG

SEQ ID NO: 601 - protein, 11 aa, Artificial Sequence
  source: /note="Description of Artificial Sequence: Synthetic peptide"
GSIESGLYYWG

SEQ ID NO: 602 - protein, 11 aa, Artificial Sequence
  source: /note="Description of Artificial Sequence: Synthetic peptide"
GSIESGLYYWG

SEQ ID NO: 603 - protein, 16 aa, Artificial Sequence
  source: /note="Description of Artificial Sequence: Synthetic peptide"
SIYYSGGTYYNPSLKS

SEQ ID NO: 604 - protein, 16 aa, Artificial Sequence
  source: /note="Description of Artificial Sequence: Synthetic peptide"
SIYYSGSTYYNPSLKS

SEQ ID NO: 605 - protein, 16 aa, Artificial Sequence
  source: /note="Description of Artificial Sequence: Synthetic peptide"
SIYYSGQTYYNPSLKS

SEQ ID NO: 606 - protein, 16 aa, Artificial Sequence
  source: /note="Description of Artificial Sequence: Synthetic peptide"
SIYYSGSTYYNPSLKS

SEQ ID NO: 607 - protein, 16 aa, Artificial Sequence
  source: /note="Description of Artificial Sequence: Synthetic peptide"
SIYYSGSTYYNPSLKS

SEQ ID NO: 608 - protein, 15 aa, Artificial Sequence
  source: /note="Description of Artificial Sequence: Synthetic peptide"
ARDGVLTLNKRSFDI

SEQ ID NO: 609 - protein, 15 aa, Artificial Sequence
  source: /note="Description of Artificial Sequence: Synthetic peptide"
ARDGVLTLNKRSFDI

SEQ ID NO: 610 - protein, 15 aa, Artificial Sequence
  source: /note="Description of Artificial Sequence: Synthetic peptide"
ARDGVLTLNKRSFDI

SEQ ID NO: 611 - protein, 15 aa, Artificial Sequence
  source: /note="Description of Artificial Sequence: Synthetic peptide"
ARDGVLTLNKRSFDI

SEQ ID NO: 612 - protein, 15 aa, Artificial Sequence
  source: /note="Description of Artificial Sequence: Synthetic peptide"
ARDGVLALNKRSFDI

SEQ ID NO: 613 - protein, 123 aa, Artificial Sequence
  source: /note="Description of Artificial Sequence: Synthetic polypeptide"
QLQLQESGPGLVKPSETLSLTCTVSGGSIESGSYYWGWIRQPPGKGLEWIGSIYYSGGTYYNPSLKSRVTISVDTSKNQFSLKLSSVTAADTAVYYCARDGVLTLNKRSFDIWGQGTMVTVSS

SEQ ID NO: 614 - protein, 123 aa, Artificial Sequence
  source: /note="Description of Artificial Sequence: Synthetic polypeptide"
QVQLQESGPGLVKPSQTLSLTCTVSGGSIESGVYYWGWIRQPPGKGLEWIGSIYYSGSTYYNPSLKSRVTISVDTSKNQFSLKLSSVTAADTAVYYCARDGVLTLNKRSFDIWGQGTMVTVSS

SEQ ID NO: 615 - protein, 123 aa, Artificial Sequence
  source: /note="Description of Artificial Sequence: Synthetic polypeptide"
QLQLQESGPGLVKPSETLSLTCTVSGGSIASGSYYWGWIRQPPGKGLEWIGSIYYSGQTYYNPSLKSRVTISVDTSKNQFSLKLSSVTAADTAVYYCARDGVLTLNKRSFDIWGQGTMVTVSS

SEQ ID NO: 616 - protein, 123 aa, Artificial Sequence
  source: /note="Description of Artificial Sequence: Synthetic polypeptide"
QVQLQESGPGLVKPSQTLSLTCTVSGGSIESGLYYWGWIRQPPGKGLEWIGSIYYSGSTYYNPSLKSRVTISVDTSKNQFSLKLSSVTAADTAVYYCARDGVLTLNKRSFDIWGQGTMVTVSS

SEQ ID NO: 617 - protein, 123 aa, Artificial Sequence
  source: /note="Description of Artificial Sequence: Synthetic polypeptide"
QVQLQESGPGLVKPSQTLSLTCTVSGGSIESGLYYWGWIRQPPGKGLEWIGSIYYSGSTYYNPSLKSRATISVDTSKNQFSLKLSSVTAADTAVYYCARDGVLALNKRSFDIWGQGTMVTVSS

SEQ ID NO: 618 - protein, 12 aa, Artificial Sequence
  source: /note="Description of Artificial Sequence: Synthetic peptide"
RASQSVSSSYLA

SEQ ID NO: 619 - protein, 12 aa, Artificial Sequence
  source: /note="Description of Artificial Sequence: Synthetic peptide"
RASQSVSSSYLA

SEQ ID NO: 620 - protein, 12 aa, Artificial Sequence
  source: /note="Description of Artificial Sequence: Synthetic peptide"
RASQSVSSSYLA

SEQ ID NO: 621 - protein, 12 aa, Artificial Sequence
  source: /note="Description of Artificial Sequence: Synthetic peptide"
RASQSVSSSYLA

SEQ ID NO: 622 - protein, 12 aa, Artificial Sequence
  source: /note="Description of Artificial Sequence: Synthetic peptide"
RASQSVSSSYLA

SEQ ID NO: 623 - protein, 7 aa, Artificial Sequence
  source: /note="Description of Artificial Sequence: Synthetic peptide"
GASSRAT

SEQ ID NO: 624 - protein, 7 aa, Artificial Sequence
  source: /note="Description of Artificial Sequence: Synthetic peptide"
GASSRAT

SEQ ID NO: 625 - protein, 7 aa, Artificial Sequence
  source: /note="Description of Artificial Sequence: Synthetic peptide"
GASSRAT

SEQ ID NO: 626 - protein, 7 aa, Artificial Sequence
  source: /note="Description of Artificial Sequence: Synthetic peptide"
GASSRAT

SEQ ID NO: 627 - protein, 7 aa, Artificial Sequence
  source: /note="Description of Artificial Sequence: Synthetic peptide"
GASSRAT

SEQ ID NO: 628 - protein, 10 aa, Artificial Sequence
  source: /note="Description of Artificial Sequence: Synthetic peptide"
QQHTVRPPLT

SEQ ID NO: 629 - protein, 10 aa, Artificial Sequence
  source: /note="Description of Artificial Sequence: Synthetic peptide"
QQHTVRPPLT

SEQ ID NO: 630 - protein, 10 aa, Artificial Sequence
  source: /note="Description of Artificial Sequence: Synthetic peptide"
QQHTVRPPLT

SEQ ID NO: 631 - protein, 10 aa, Artificial Sequence
  source: /note="Description of Artificial Sequence: Synthetic peptide"
QQHTVRPPLT

SEQ ID NO: 632 - protein, 10 aa, Artificial Sequence
  source: /note="Description of Artificial Sequence: Synthetic peptide"
QQHTVRPPLT

SEQ ID NO: 633 - protein, 109 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQHTVRPPLTFGGGTKVEIK

SEQ ID NO: 634 - protein, 109 aa, Artificial Sequence; identical to SEQ ID NO: 633
  source: /note="Description of Artificial Sequence: Synthetic polypeptide"

SEQ ID NO: 635 - protein, 109 aa, Artificial Sequence; identical to SEQ ID NO: 633
  source: /note="Description of Artificial Sequence: Synthetic polypeptide"

SEQ ID NO: 636 - protein, 109 aa, Artificial Sequence; identical to SEQ ID NO: 633
  source: /note="Description of Artificial Sequence: Synthetic polypeptide"

SEQ ID NO: 637 - protein, 109 aa, Artificial Sequence; identical to SEQ ID NO: 633
  source: /note="Description of Artificial Sequence: Synthetic polypeptide"

SEQ ID NO: 638 - protein, 11 aa, Artificial Sequence
  source: /note="Description of Artificial Sequence: Synthetic peptide"
GSIESGLYYWG

SEQ ID NO: 639 - protein, 11 aa, Artificial Sequence
  source: /note="Description of Artificial Sequence: Synthetic peptide"
GSIESGLYYWG

SEQ ID NO: 640 - protein, 9 aa, Artificial Sequence
  source: /note="Description of Artificial Sequence: Synthetic peptide"
YTFGNYYMH

SEQ ID NO: 641 - protein, 9 aa, Artificial Sequence
  source: /note="Description of Artificial Sequence: Synthetic peptide"
YTFPAYYMH

SEQ ID NO: 642 - protein, 9 aa, Artificial Sequence
  source: /note="Description of Artificial Sequence: Synthetic peptide"
YTFREYYMH

SEQ ID NO: 643 - protein, 16 aa, Artificial Sequence
  source: /note="Description of Artificial Sequence: Synthetic peptide"
SIYYSGSTYYNPSLKS

SEQ ID NO: 644 - protein, 16 aa, Artificial Sequence
  source: /note="Description of Artificial Sequence: Synthetic peptide"
SIYYSGSTYYNPSLKS

SEQ ID NO: 645 - protein, 17 aa, Artificial Sequence
  source: /note="Description of Artificial Sequence: Synthetic peptide"
IINPSLGLTSYAQKFQG

SEQ ID NO: 646 - protein, 17 aa, Artificial Sequence
  source: /note="Description of Artificial Sequence: Synthetic peptide"
IINPSLGLTSYAQKFQG

SEQ ID NO: 647 - protein, 17 aa, Artificial Sequence
  source: /note="Description of Artificial Sequence: Synthetic peptide"
IINPSIGLTSYARKFQG

SEQ ID NO: 648 - protein, 15 aa, Artificial Sequence
  source: /note="Description of Artificial Sequence: Synthetic peptide"
ARDGVLALNKRSFDI

SEQ ID NO: 649 - protein, 15 aa, Artificial Sequence
  source: /note="Description of Artificial Sequence: Synthetic peptide"
ARDGVLALNKRSFDI

SEQ ID NO: 650 - protein, 14 aa, Artificial Sequence
  source: /note="Description of Artificial Sequence: Synthetic peptide"
ARGGRTTWIGAFDI

SEQ ID NO: 651 - protein, 14 aa, Artificial Sequence
  source: /note="Description of Artificial Sequence: Synthetic peptide"
ARGGRTTWIGAFDI

SEQ ID NO: 652 - protein, 14 aa, Artificial Sequence
  source: /note="Description of Artificial Sequence: Synthetic peptide"
ARGGRTTWIGAFDI

SEQ ID NO: 653 - protein, 123 aa, Artificial Sequence
  source: /note="Description of Artificial Sequence: Synthetic polypeptide"
QVQLQESGPGLVKPSQTLSLTCTVSGGSIESGLYYWGWIRQPPGKGLEWIGSIYYSGSTYYNPSLKSRVTISVDTSKNQFSLKLSSVTAADTAVYYCARDGVLALNKRSFDIWGQGTMVTVSS

SEQ ID NO: 654 - protein, 123 aa, Artificial Sequence
  source: /note="Description of Artificial Sequence: Synthetic polypeptide"
QVQLQESGPGLVKPSQTLSLTCTASGGSIESGLYYWGWIRQPPGKGLEWIGSIYYSGSTYYNPSLKSRVTISVDTSKNQFSLKLSSVTAADTAVYYCARDGVLALNKRSFDIWGQGTMVTVSS

SEQ ID NO: 655 - protein, 121 aa, Artificial Sequence
  source: /note="Description of Artificial Sequence: Synthetic polypeptide"
QVQLVQSGAEVKKPGASVKVSCKASGYTFGNYYMHWVRQAPGQGLEWMGIINPSLGLTSYAQKFQGRVTMTRDTSTSTVYMELSSLRSEDTAVYYCARGGRTTWIGAFDIWGQGTMVTVSS

SEQ ID NO: 656 - protein, 121 aa, Artificial Sequence
  source: /note="Description of Artificial Sequence: Synthetic polypeptide"
QVQLVQSGAEVKKPGASVKVSCKASGYTFPAYYMHWVRQAPGQGLEWMGIINPSLGLTSYAQKFQGRVTMTRDTSTSTVYMELSSLRSEDTAVYYCARGGRTTWIGAFDIWGQGTMVTVSS

SEQ ID NO: 657 - protein, 121 aa, Artificial Sequence
  source: /note="Description of Artificial Sequence: Synthetic polypeptide"
QVQLVQSGAEVKKPGASVKVSCKASGYTFREYYMHWVRQAPGQGLEWMGIINPSIGLTSYARKFQGRVTMTRDTSTSTVYMELSSLRSEDTAVYYCARGGRTTWIGAFDIWGQGTMVTVSS

SEQ ID NO: 658 - protein, 12 aa, Artificial Sequence
  source: /note="Description of Artificial Sequence: Synthetic peptide"
RASQSVSSSYLA

SEQ ID NO: 659 - protein, 12 aa, Artificial Sequence
  source: /note="Description of Artificial Sequence: Synthetic peptide"
RASQSVSSSYLA

SEQ ID NO: 660 - protein, 11 aa, Artificial Sequence
  source: /note="Description of Artificial Sequence: Synthetic peptide"
RASQSVSSNLA

SEQ ID NO: 661 - protein, 11 aa, Artificial Sequence
  source: /note="Description of Artificial Sequence: Synthetic peptide"
RASQSVSSNLA

SEQ ID NO: 662 - protein, 11 aa, Artificial Sequence
  source: /note="Description of Artificial Sequence: Synthetic peptide"
RASQSVSSNLA

SEQ ID NO: 663 - protein, 7 aa, Artificial Sequence
  source: /note="Description of Artificial Sequence: Synthetic peptide"
GASSRAT

SEQ ID NO: 664 - protein, 7 aa, Artificial Sequence
  source: /note="Description of Artificial Sequence: Synthetic peptide"
GASSRAT

SEQ ID NO: 665 - protein, 7 aa, Artificial Sequence
  source: /note="Description of Artificial Sequence: Synthetic peptide"
GASTRAT

SEQ ID NO: 666 - protein, 7 aa, Artificial Sequence
  source: /note="Description of Artificial Sequence: Synthetic peptide"
GASTRAT

SEQ ID NO: 667 - protein, 7 aa, Artificial Sequence
  source: /note="Description of Artificial Sequence: Synthetic peptide"
GASTRAT

SEQ ID NO: 668 - protein, 10 aa, Artificial Sequence
  source: /note="Description of Artificial Sequence: Synthetic peptide"
QQHTVRPPLT

SEQ ID NO: 669 - protein, 10 aa, Artificial Sequence
  source: /note="Description of Artificial Sequence: Synthetic peptide"
QQHTVRPPLT

SEQ ID NO: 670 - protein, 10 aa, Artificial Sequence
  source: /note="Description of Artificial Sequence: Synthetic peptide"
QQYVVWPPLT

SEQ ID NO: 671 - protein, 10 aa, Artificial Sequence
  source: /note="Description of Artificial Sequence: Synthetic peptide"
QQYVVWPPLT

SEQ ID NO: 672 - protein, 10 aa, Artificial Sequence
  source: /note="Description of Artificial Sequence: Synthetic peptide"
QQYVVWPPLT

SEQ ID NO: 673 - protein, 109 aa, Artificial Sequence; identical to SEQ ID NO: 633
  source: /note="Description of Artificial Sequence: Synthetic polypeptide"

SEQ ID NO: 674 - protein, 109 aa, Artificial Sequence; identical to SEQ ID NO: 633
  source: /note="Description of Artificial Sequence: Synthetic polypeptide"

SEQ ID NO: 675 - protein, 108 aa, Artificial Sequence
  source: /note="Description of Artificial Sequence: Synthetic polypeptide"
EIVMTQSPATISVSPGERATLSCRASQSVSSNLAWYQQKPGQAPRLLIYGASTRATGIPARFSGSGSGTEFTLTISSLQSEDFAVYYCQQYVVWPPLTFGGGTKVEIK

SEQ ID NO: 676 - protein, 108 aa, Artificial Sequence
  source: /note="Description of Artificial Sequence: Synthetic polypeptide"
EIVMTQSPATLSVSPGERATLSCRASQSVSSNLAWYQQKPGQAPRLLIYGASTRATGIPARFSGSGSGTEFTLTISSLQSEDFAVYYCQQYVVWPPLTFGGGTKVEIK

SEQ ID NO: 677 - protein, 108 aa, Artificial Sequence; identical to SEQ ID NO: 676
  source: /note="Description of Artificial Sequence: Synthetic polypeptide"

SEQ ID NO: 678 - protein, 9 aa, Artificial Sequence
  source: /note="Description of Artificial Sequence: Synthetic peptide"
YTFREYYMH

SEQ ID NO: 679 - protein, 9 aa, Artificial Sequence
  source: /note="Description of Artificial Sequence: Synthetic peptide"
YTFPAYYIH

SEQ ID NO: 680 - protein, 9 aa, Artificial Sequence
  source: /note="Description of Artificial Sequence: Synthetic peptide"
YTFPAYYMH

SEQ ID NO: 681 - protein, 9 aa, Artificial Sequence
  source: /note="Description of Artificial Sequence: Synthetic peptide"
YTFTSHYMG

SEQ ID NO: 682 - protein, 9 aa, Artificial Sequence
  source: /note="Description of Artificial Sequence: Synthetic peptide"
YTFTSHYMG

SEQ ID NO: 683 - protein, 9 aa, Artificial Sequence
  source: /note="Description of Artificial Sequence: Synthetic peptide"
YTFTSHYMG

SEQ ID NO: 684 - protein, 17 aa, Artificial Sequence
  source: /note="Description of Artificial Sequence: Synthetic peptide"
IINPSIGLTSYARKFQG

SEQ ID NO: 685 - protein, 17 aa, Artificial Sequence
  source: /note="Description of Artificial Sequence: Synthetic peptide"
IINPSLGLTSYARKFQG

SEQ ID NO: 686 - protein, 17 aa, Artificial Sequence
  source: /note="Description of Artificial Sequence: Synthetic peptide"
IINPSLGLTSYARKFQG

SEQ ID NO: 687 - protein, 17 aa, Artificial Sequence
  source: /note="Description of Artificial Sequence: Synthetic peptide"
VINPSMGATSYAQKFQG

SEQ ID NO: 688 - protein, 17 aa, Artificial Sequence
  source: /note="Description of Artificial Sequence: Synthetic peptide"
IINPSMGATSYAQKFQG

SEQ ID NO: 689 - protein, 17 aa, Artificial Sequence
  source: /note="Description of Artificial Sequence: Synthetic peptide"
IINPSMGATSYTQKFRG

SEQ ID NO: 690 - protein, 14 aa, Artificial Sequence
  source: /note="Description of Artificial Sequence: Synthetic peptide"
ARGGRTTWIGALDI

SEQ ID NO: 691 - protein, 14 aa, Artificial Sequence
  source: /note="Description of Artificial Sequence: Synthetic peptide"
ARGGRTTWIGALDI

SEQ ID NO: 692 - protein, 14 aa, Artificial Sequence
  source: /note="Description of Artificial Sequence: Synthetic peptide"
ARGGRTTWIGAFDI

SEQ ID NO: 693 - protein, 16 aa, Artificial Sequence
  source: /note="Description of Artificial Sequence: Synthetic peptide"
ARLHVSGSYYPAYLDY

SEQ ID NO: 694 - protein, 16 aa, Artificial Sequence
  source: /note="Description of Artificial Sequence: Synthetic peptide"
ARLHVSGSYYPAYLDY

SEQ ID NO: 695 - protein, 16 aa, Artificial Sequence
  source: /note="Description of Artificial Sequence: Synthetic peptide"
ARLHVSGSYYPAYLDY

SEQ ID NO: 696 - protein, 121 aa, Artificial Sequence
  source: /note="Description of Artificial Sequence: Synthetic polypeptide"
QVQLVQSGAEVKKPGASVKVSCKASGYTFREYYMHWVRQAPGQGLEWMGIINPSIGLTSYARKFQGRVTMTRDTSTSTVYMELSSLRSEDTAVYYCARGGRTTWIGALDIWGQGTMVTVSS

SEQ ID NO: 697 - protein, 121 aa, Artificial Sequence
  source: /note="Description of Artificial Sequence: Synthetic polypeptide"
QVQLVQSGAEVKKPGASVKVSCKASGYTFPAYYIHWVRQAPGQGLEWMGIINPSLGLTSYARKFQGRVTMTRDTSTSTVYMELSSLRSEDTAVYYCARGGRTTWIGALDIWGQGTMVTVSS

SEQ ID NO: 698 - protein, 121 aa, Artificial Sequence
  source: /note="Description of Artificial Sequence: Synthetic polypeptide"
QVQLVQSGAEVKKPGASVKVSCKASGYTFPAYYMHWVRQAPGQGLEWMGIINPSLGLTSYARKFQGRVTMTRDTSTSTVYMELSSLRSEDTAVYYCARGGRTTWIGAFDIWGQGTMVTVSS

SEQ ID NO: 699 - protein, 124 aa, Artificial Sequence
  source: /note="Description of Artificial Sequence: Synthetic polypeptide"
QVQLVQSGAEVKKPGASVKVSCKASGYTFTSHYMGWVRQAPGQGLEWMGVINPSMGATSYAQKFQGRVTMTRDTSTLSTVYMELSSLRSEDTAVYYCARLHVSGSYYPAYLDYWGQGTMVTVSS

SEQ ID NO: 700 - protein, 123 aa, Artificial Sequence
  source: /note="Description of Artificial Sequence: Synthetic polypeptide"
QVQLVQSGAEVKKPGASVKVSCKASGYTFTSHYMGWVRQAPGQGLEWVGIINPSMGATSYAQKFQGRVTMTRDTSTSTVYMELSSLASEDTAVYYCARLHVSGSYYPAYLDYWGQGTMVTVSS

SEQ ID NO: 701 - protein, 123 aa, Artificial Sequence
  source: /note="Description of Artificial Sequence: Synthetic polypeptide"
QVQLVQSGAEVKKPGASVKVSCKASGYTFTSHYMGWVRQAPGQGLEWMGIINPSMGATSYTQKFRGRVTMTRDTSTSTVYMELSSLASEDTAVYYCARLHVSGSYYPAYLDYWGQGTMVTVSS

SEQ ID NO: 702 - protein, 11 aa, Artificial Sequence
  source: /note="Description of Artificial Sequence: Synthetic peptide"
RASQSVSSNLA

SEQ ID NO: 703 - protein, 11 aa, Artificial Sequence
  source: /note="Description of Artificial Sequence: Synthetic peptide"
RASQSVSSNLA

SEQ ID NO: 704 - protein, 11 aa, Artificial Sequence
  source: /note="Description of Artificial Sequence: Synthetic peptide"
RASQSVSSNLA

SEQ ID NO: 705 - protein, 11 aa, Artificial Sequence
  source: /note="Description of Artificial Sequence: Synthetic peptide"
RASQSVSSNLA

SEQ ID NO: 706 - protein, 11 aa, Artificial Sequence
  source: /note="Description of Artificial Sequence: Synthetic peptide"
RASQSVSSNLA

SEQ ID NO: 707 - protein, 11 aa, Artificial Sequence
  source: /note="Description of Artificial Sequence: Synthetic peptide"
RASQSVSSNLA

SEQ ID NO: 708 - protein, 7 aa, Artificial Sequence
  source: /note="Description of Artificial Sequence: Synthetic peptide"
GASTRAT

SEQ ID NO: 709 - protein, 7 aa, Artificial Sequence
  source: /note="Description of Artificial Sequence: Synthetic peptide"
GASTRAT

SEQ ID NO: 710 - protein, 7 aa, Artificial Sequence
  source: /note="Description of Artificial Sequence: Synthetic peptide"
GASTRAT

SEQ ID NO: 711 - protein, 7 aa, Artificial Sequence
  source: /note="Description of Artificial Sequence: Synthetic peptide"
GASTRAT

SEQ ID NO: 712 - protein, 7 aa, Artificial Sequence
  source: /note="Description of Artificial Sequence: Synthetic peptide"
GASTRAT

SEQ ID NO: 713 - protein, 7 aa, Artificial Sequence
  source: /note="Description of Artificial Sequence: Synthetic peptide"
GASTRAT

SEQ ID NO: 714 - protein, 10 aa, Artificial Sequence
  source: /note="Description of Artificial Sequence: Synthetic peptide"
QQYVVWPPLT

SEQ ID NO: 715 - protein, 10 aa, Artificial Sequence
  source: /note="Description of Artificial Sequence: Synthetic peptide"
QQYVVWPPLT

SEQ ID NO: 716 - protein, 10 aa, Artificial Sequence
  source: /note="Description of Artificial Sequence: Synthetic peptide"
QQYVVWPPLT

SEQ ID NO: 717 - protein, 9 aa, Artificial Sequence
  source: /note="Description of Artificial Sequence: Synthetic peptide"
QQYIVFPWT

SEQ ID NO: 718 - protein, 9 aa, Artificial Sequence
  source: /note="Description of Artificial Sequence: Synthetic peptide"
QQYIVFPWT

SEQ ID NO: 719 - protein, 9 aa, Artificial Sequence
  source: /note="Description of Artificial Sequence: Synthetic peptide"
QQYIVFPWT

SEQ ID NO: 720 - protein, 108 aa, Artificial Sequence; identical to SEQ ID NO: 676
  source: /note="Description of Artificial Sequence: Synthetic polypeptide"

SEQ ID NO: 721 - protein, 108 aa, Artificial Sequence; identical to SEQ ID NO: 676
  source: /note="Description of Artificial Sequence: Synthetic polypeptide"

SEQ ID NO: 722 - protein, 108 aa, Artificial Sequence; identical to SEQ ID NO: 676
  source: /note="Description of Artificial Sequence: Synthetic polypeptide"

SEQ ID NO: 723 - protein, 107 aa, Artificial Sequence
  source: /note="Description of Artificial Sequence: Synthetic polypeptide"
EIVMTQSPATLSVSPGERATLSCRASQSVSSNLAWYQQKPGQAPRHLIYGASTRATGIPARFSGSGSGTEFTLTISSLQSEDFAVYYCQQYIVFPWTFGGGTKVEIK

SEQ ID NO: 724 - protein, 107 aa, Artificial Sequence; identical to SEQ ID NO: 723
  source: /note="Description of Artificial Sequence: Synthetic polypeptide"

SEQ ID NO: 725 - protein, 107 aa, Artificial Sequence; identical to SEQ ID NO: 723
  source: /note="Description of Artificial Sequence: Synthetic polypeptide"

SEQ ID NO: 726 - protein, 127 aa, Artificial Sequence
  source: /note="Description of Artificial Sequence: Synthetic polypeptide"
EVQLQESGPGLVKPSQSLSLTCSVTGSSIASDYWGWIRKFPGNKMEWMGFITYSGSTSYNPSLKSRISITRDTSKNQFFLQLHSVTTDDTATYSCARMPSFITLASLSTWEGYFDFWGPGTMVTVSS

SEQ ID NO: 727 - protein, 5 aa, Artificial Sequence
  source: /note="Description of Artificial Sequence: Synthetic peptide"
SDYWG

SEQ ID NO: 728 - protein, 16 aa, Artificial Sequence
  source: /note="Description of Artificial Sequence: Synthetic peptide"
FITYSGSTSYNPSLKS

SEQ ID NO: 729 - protein, 19 aa, Artificial Sequence
  source: /note="Description of Artificial Sequence: Synthetic peptide"
MPSFITLASLSTWEGYFDF

SEQ ID NO: 730 - protein, 106 aa, Artificial Sequence
  source: /note="Description of Artificial Sequence: Synthetic polypeptide"
DIQMTQSPSLLSASVGDRVTLNCKASQSIHKNLAWYQQKLGEAPKFLIYYANSLQTGIPSRFSGSGSGTDFTLTISGLQPEDVATYFCQQYYSGWTFGGGTKVELK

SEQ ID NO: 731 - protein, 11 aa, Artificial Sequence
  source: /note="Description of Artificial Sequence: Synthetic peptide"
KASQSIHKNLA

SEQ ID NO: 732 - protein, 7 aa, Artificial Sequence
  source: /note="Description of Artificial Sequence: Synthetic peptide"
YANSLQT

SEQ ID NO: 733 - protein, 8 aa, Artificial Sequence
  source: /note="Description of Artificial Sequence: Synthetic peptide"
QQYYSGWT

SEQ ID NO: 734 - protein, 127 aa, Artificial Sequence
  source: /note="Description of Artificial Sequence: Synthetic polypeptide"
EVQLQESGPGLVKPSETLSLTCTVSGGSISSDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 735 - protein, 4 aa, Artificial Sequence
  source: /note="Description of Artificial Sequence: Synthetic peptide"
DYWG

SEQ ID NO: 736 - protein, 16 aa, Artificial Sequence
  source: /note="Description of Artificial Sequence: Synthetic peptide"
FITYSGSTSYNPSLKS

SEQ ID NO: 737 - protein, 19 aa, Artificial Sequence
  source: /note="Description of Artificial Sequence: Synthetic peptide"
MPSFITLASLSTWEGYFDF

SEQ ID NO: 738 - protein, 127 aa, Artificial Sequence
  source: /note="Description of Artificial Sequence: Synthetic polypeptide"
EVQLQESGPGLVKPSETLSLTCTVSGGSISSDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 739 - protein, 5 aa, Artificial Sequence
  source: /note="Description of Artificial Sequence: Synthetic peptide"
SDYWG

SEQ ID NO: 740 - protein, 16 aa, Artificial Sequence
  source: /note="Description of Artificial Sequence: Synthetic peptide"
FITYSGSTSYNPSLKS

SEQ ID NO: 741 - protein, 19 aa, Artificial Sequence
  source: /note="Description of Artificial Sequence: Synthetic peptide"
MPSFITLASLSTWEGYFDF

SEQ ID NO: 742 - protein, 127 aa, Artificial Sequence
  source: /note="Description of Artificial Sequence: Synthetic polypeptide"
EVQLQESGPGLVKPSETLSLTCTVSGGSISSDYWGWIRQPPGKGLEWIGFITYSGSTSYNPSLKSRITISRDTSKNQFSLKLSSVTAADTAVYYCARMPSFITLASLSTWEGYFDFWGQGTMVTVSS

SEQ ID NO: 743 - protein, 5 aa, Artificial Sequence
  source: /note="Description of Artificial Sequence: Synthetic peptide"
SDYWG

SEQ ID NO: 744 - protein, 16 aa, Artificial Sequence
  source: /note="Description of Artificial Sequence: Synthetic peptide"
FITYSGSTSYNPSLKS

SEQ ID NO: 745 - protein, 19 aa, Artificial Sequence
  source: /note="Description of Artificial Sequence: Synthetic peptide"
MPSFITLASLSTWEGYFDF

SEQ ID NO: 746 - protein, 127 aa, Artificial Sequence
  source: /note="Description of Artificial Sequence: Synthetic polypeptide"
EVQLQESGPGLVKPSETLSLTCTVSGSSISSDYWGWIRQPPGKGLEWMGFITYSGSTSYNPSLKSRITISRDTSKNQFSLKLSSVTAADTAVYYCARMPSFITLASLSTWEGYFDFWGQGTMVTVSS

SEQ ID NO: 747 - protein, 5 aa, Artificial Sequence
  source: /note="Description of Artificial Sequence: Synthetic peptide"
SDYWG

SEQ ID NO: 748 - protein, 16 aa, Artificial Sequence
  source: /note="Description of Artificial Sequence: Synthetic peptide"
FITYSGSTSYNPSLKS

SEQ ID NO: 749 - protein, 19 aa, Artificial Sequence
  source: /note="Description of Artificial Sequence: Synthetic peptide"
MPSFITLASLSTWEGYFDF

SEQ ID NO: 750 - protein, 127 aa, Artificial Sequence
  source: /note="Description of Artificial Sequence: Synthetic polypeptide"
EVQLQESGPGLVKPSETLSLTCTVSGGSISSDYWGWIRQPPGKGLEWIGFITYSGSTSYNPSLKSRVTISRDTSKNQFSLKLHSVTAADTAVYYCARMPSFITLASLSTWEGYFDFWGQGTMVTVSS

SEQ ID NO: 751 - protein, 5 aa, Artificial Sequence
  source: /note="Description of Artificial Sequence: Synthetic peptide"
SDYWG

SEQ ID NO: 752 - protein, 16 aa, Artificial Sequence
  source: /note="Description of Artificial Sequence: Synthetic peptide"
FITYSGSTSYNPSLKS

SEQ ID NO: 753 - protein, 19 aa, Artificial Sequence
  source: /note="Description of Artificial Sequence: Synthetic peptide"
MPSFITLASLSTWEGYFDF

SEQ ID NO: 754 - protein, 127 aa, Artificial Sequence
  source: /note="Description of Artificial Sequence: Synthetic polypeptide"
EVQLQESGPGLVKPSETLSLTCTVSGGSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 755 - protein, 5 aa, Artificial Sequence
  source: /note="Description of Artificial Sequence: Synthetic peptide"
SDYWG

SEQ ID NO: 756 - protein, 17 aa, Artificial Sequence
  source: /note="Description of Artificial Sequence: Synthetic peptide"
GFITYSGSTSYNPSLKS

SEQ ID NO: 757 - protein, 19 aa, Artificial Sequence
  source: /note="Description of Artificial Sequence: Synthetic peptide"
MPSFITLASLSTWEGYFDF

SEQ ID NO: 758 - protein, 127 aa, Artificial Sequence
  source: /note="Description of Artificial Sequence: Synthetic polypeptide"
EVQLQESGPGLVKPSETLSLTCTVSGSSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 759 - protein, 5 aa, Artificial Sequence
  source: /note="Description of Artificial Sequence: Synthetic peptide"
SDYWG

SEQ ID NO: 760 - protein, 16 aa, Artificial Sequence
  source: /note="Description of Artificial Sequence: Synthetic peptide"
FITYSGSTSYNPSLKS

SEQ ID NO: 761 - protein, 19 aa, Artificial Sequence
  source: /note="Description of Artificial Sequence: Synthetic peptide"
MPSFITLASLSTWEGYFDF

SEQ ID NO: 762 - protein, 127 aa, Artificial Sequence
  source: /note="Description of Artificial Sequence: Synthetic polypeptide"
EVQLQESGPGLVKPSETLSLTCTVSGSSISSDYWGWIRQPPGKGLEWMGFITYSGSTSYNPSLKSRITISVDTSKNQFSLKLHSVTAADTAVYYCARMPSFITLASLSTWEGYFDFWGQGTMVTVSS

SEQ ID NO: 763 - protein, 5 aa, Artificial Sequence
  source: /note="Description of Artificial Sequence: Synthetic peptide"
SDYWG

SEQ ID NO: 764 - protein, 16 aa, Artificial Sequence
  source: /note="Description of Artificial Sequence: Synthetic peptide"
FITYSGSTSYNPSLKS

SEQ ID NO: 765 - protein, 19 aa, Artificial Sequence
  source: /note="Description of Artificial Sequence: Synthetic peptide"
MPSFITLASLSTWEGYFDF

SEQ ID NO: 766 - protein, 127 aa, Artificial Sequence
  source: /note="Description of Artificial Sequence: Synthetic polypeptide"
EVQLQESGPGLVKPSETLSLTCAVSGYSISSDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 767 - protein, 5 aa, Artificial Sequence
  source: /note="Description of Artificial Sequence: Synthetic peptide"
SDYWG

SEQ ID NO: 768 - protein, 16 aa, Artificial Sequence
  source: /note="Description of Artificial Sequence: Synthetic peptide"
FITYSGSTSYNPSLKS

SEQ ID NO: 769 - protein, 19 aa, Artificial Sequence
  source: /note="Description of Artificial Sequence: Synthetic peptide"
MPSFITLASLSTWEGYFDF

SEQ ID NO: 770 - protein, 127 aa, Artificial Sequence
  source: /note="Description of Artificial Sequence: Synthetic polypeptide"
EVQLQESGPGLVKPSETLSLTCAVSGYSISSDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 771 - protein, 5 aa, Artificial Sequence
  source: /note="Description of Artificial Sequence: Synthetic peptide"
SDYWG

SEQ ID NO: 772 - protein, 16 aa, Artificial Sequence
  source: /note="Description of Artificial Sequence: Synthetic peptide"
FITYSGSTSYNPSLKS

SEQ ID NO: 773 - protein, 19 aa, Artificial Sequence
  source: /note="Description of Artificial Sequence: Synthetic peptide"
MPSFITLASLSTWEGYFDF

SEQ ID NO: 774 - protein, 127 aa, Artificial Sequence
  source: /note="Description of Artificial Sequence: Synthetic polypeptide"
EVQLQESGPGLVKPSETLSLTCAVSGYSISSDYWGWIRQPPGKGLEWIGFITYSGSTSYNPSLKSRITISRDTSKNQFSLKLSSVTAADTAVYYCARMPSFITLASLSTWEGYFDFWGQGTMVTVSS

SEQ ID NO: 775 - protein, 5 aa, Artificial Sequence
  source: /note="Description of Artificial Sequence: Synthetic peptide"
SDYWG

SEQ ID NO: 776 - protein, 16 aa, Artificial Sequence
  source: /note="Description of Artificial Sequence: Synthetic peptide"
FITYSGSTSYNPSLKS

SEQ ID NO: 777 - protein, 19 aa, Artificial Sequence
  source: /note="Description of Artificial Sequence: Synthetic peptide"
MPSFITLASLSTWEGYFDF

SEQ ID NO: 778 - protein, 127 aa, Artificial Sequence
  source: /note="Description of Artificial Sequence: Synthetic polypeptide"
EVQLQESGPGLVKPSETLSLTCAVSGSSISSDYWGWIRQPPGKGLEWMGFITYSGSTSYNPSLKSRITISRDTSKNQFSLKLSSVTAADTAVYYCARMPSFITLASLSTWEGYFDFWGQGTMVTVSS

SEQ ID NO: 779 - protein, 5 aa, Artificial Sequence
  source: /note="Description of Artificial Sequence: Synthetic peptide"
SDYWG

SEQ ID NO: 780 - protein, 16 aa, Artificial Sequence
  source: /note="Description of Artificial Sequence: Synthetic peptide"
FITYSGSTSYNPSLKS

SEQ ID NO: 781 - protein, 19 aa, Artificial Sequence
  source: /note="Description of Artificial Sequence: Synthetic peptide"
MPSFITLASLSTWEGYFDF

SEQ ID NO: 782 - protein, 127 aa, Artificial Sequence
  source: /note="Description of Artificial Sequence: Synthetic polypeptide"
EVQLQESGPGLVKPSETLSLTCAVSGYSISSDYWGWIRQPPGKGLEWIGFITYSGSTSYNPSLKSRVTISRDTSKNQFSLKLHSVTAADTAVYYCARMPSFITLASLSTWEGYFDFWGQGTMVTVSS

SEQ ID NO: 783 - protein, 5 aa, Artificial Sequence
  source: /note="Description of Artificial Sequence: Synthetic peptide"
SDYWG

SEQ ID NO: 784 - protein, 16 aa, Artificial Sequence
  source: /note="Description of Artificial Sequence: Synthetic peptide"
FITYSGSTSYNPSLKS

SEQ ID NO: 785 - protein, 19 aa, Artificial Sequence
  source: /note="Description of Artificial Sequence: Synthetic peptide"
MPSFITLASLSTWEGYFDF

SEQ ID NO: 786 - protein, 127 aa, Artificial Sequence
  source: /note="Description of Artificial Sequence: Synthetic polypeptide"
EVQLQESGPGLVKPSETLSLTCAVSGYSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 787 - protein, 5 aa, Artificial Sequence
  source: /note="Description of Artificial Sequence: Synthetic peptide"
SDYWG

SEQ ID NO: 788 - protein, 16 aa, Artificial Sequence
  source: /note="Description of Artificial Sequence: Synthetic peptide"
FITYSGSTSYNPSLKS

SEQ ID NO: 789 - protein, 19 aa, Artificial Sequence
  source: /note="Description of Artificial Sequence: Synthetic peptide"
MPSFITLASLSTWEGYFDF

SEQ ID NO: 790 - protein, 129 aa, Artificial Sequence
  source: /note="Description of Artificial Sequence: Synthetic polypeptide"
EVQLQESGPGLVKPSETLSLTCTVSGSSIASDYWGWIRQPPGKGLEWIGFITYSGSTSYNPSLKSRVTISVDTSKNQFSLKLSSVTAADTAVYYCARMPSFITLASLSTWEGYFDFWGQGTMVTVSSAS

SEQ ID NO: 791 - protein, 5 aa, Artificial Sequence
  source: /note="Description of Artificial Sequence: Synthetic peptide"
SDYWG

SEQ ID NO: 792 - protein, 16 aa, Artificial Sequence
  source: /note="Description of Artificial Sequence: Synthetic peptide"
FITYSGSTSYNPSLKS

SEQ ID NO: 793 - protein, 19 aa, Artificial Sequence
  source: /note="Description of Artificial Sequence: Synthetic peptide"
MPSFITLASLSTWEGYFDF

SEQ ID NO: 794 - protein, 127 aa, Artificial Sequence
  source: /note="Description of Artificial Sequence: Synthetic polypeptide"
EVQLQESGPGLVKPSETLSLTCTVSGSSIASDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 795 - protein, 5 aa, Artificial Sequence
  source: /note="Description of Artificial Sequence: Synthetic peptide"
SDYWG

SEQ ID NO: 796 - protein, 16 aa, Artificial Sequence
  source: /note="Description of Artificial Sequence: Synthetic peptide"
FITYSGSTSYNPSLKS

SEQ ID NO: 797 - protein, 19 aa, Artificial Sequence
  source: /note="Description of Artificial Sequence: Synthetic peptide"
MPSFITLASLSTWEGYFDF

SEQ ID NO: 798 - protein, 127 aa, Artificial Sequence
  source: /note="Description of Artificial Sequence: Synthetic polypeptide"
EVQLQESGPGLVKPSETLSLTCTVSGSSIASDYWGWIRKPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 799 - protein, 5 aa, Artificial Sequence
  source: /note="Description of Artificial Sequence: Synthetic peptide"
SDYWG

SEQ ID NO: 800 - protein, 16 aa, Artificial Sequence
  source: /note="Description of Artificial Sequence: Synthetic peptide"
FITYSGSTSYNPSLKS

SEQ ID NO: 801 - protein, 19 aa, Artificial Sequence
  source: /note="Description of Artificial Sequence: Synthetic peptide"
MPSFITLASLSTWEGYFDF

SEQ ID NO: 802 - protein, 127 aa, Artificial Sequence
  source: /note="Description of Artificial Sequence: Synthetic polypeptide"
EVQLQESGPGLVKPSETLSLTCTVSGSSIASDYWGWIRQPPGKKLEWIGFITYSGSTSYNPSLKSRVTISRDTSKNQFSLKLSSVTAADTAVYYCARMPSFITLASLSTWEGYFDFWGQGTMVTVSS

SEQ ID NO: 803 - protein, 5 aa, Artificial Sequence
  source: /note="Description of Artificial Sequence: Synthetic peptide"
SDYWG

SEQ ID NO: 804 - protein, 16 aa, Artificial Sequence
  source: /note="Description of Artificial Sequence: Synthetic peptide"
FITYSGSTSYNPSLKS

SEQ ID NO: 805 - protein, 19 aa, Artificial Sequence
  source: /note="Description of Artificial Sequence: Synthetic peptide"
MPSFITLASLSTWEGYFDF

SEQ ID NO: 806 - protein, 127 aa, Artificial Sequence
  source: /note="Description of Artificial Sequence: Synthetic polypeptide"
EVQLQESGPGLVKPSETLSLTCTVSGSSIASDYWGWIRQPPGKGMEWIGFITYSGSTSYNPSLKSRVTISRDTSKNQFSLKLSSVTAADTAVYYCARMPSFITLASLSTWEGYFDFWGQGTMVTVSS

SEQ ID NO: 807 - protein, 5 aa, Artificial Sequence
  source: /note="Description of Artificial Sequence: Synthetic peptide"
SDYWG

SEQ ID NO: 808 - protein, 16 aa, Artificial Sequence
  source: /note="Description of Artificial Sequence: Synthetic peptide"
FITYSGSTSYNPSLKS

SEQ ID NO: 809 - protein, 19 aa, Artificial Sequence
  source: /note="Description of Artificial Sequence: Synthetic peptide"
MPSFITLASLSTWEGYFDF

SEQ ID NO: 810 - protein, 127 aa, Artificial Sequence
  source: /note="Description of Artificial Sequence: Synthetic polypeptide"
EVQLQESGPGLVKPSETLSLTCTVSGSSIASDYWGWIRKPPGKKMEWIGFITYSGSTSYNPSLKSRVTISRDTSKNQFSLKLSSVTAADTAVYYCARMPSFITLASLSTWEGYFDFWGQGTMVTVSS

SEQ ID NO: 811 - protein, 5 aa, Artificial Sequence
  source: /note="Description of Artificial Sequence: Synthetic peptide"
SDYWG

SEQ ID NO: 812 - protein, 16 aa, Artificial Sequence
  source: /note="Description of Artificial Sequence: Synthetic peptide"
FITYSGSTSYNPSLKS

SEQ ID NO: 813 - protein, 19 aa, Artificial Sequence
  source: /note="Description of Artificial Sequence: Synthetic peptide"
MPSFITLASLSTWEGYFDF

SEQ ID NO: 814 - protein, 127 aa, Artificial Sequence
  source: /note="Description of Artificial Sequence: Synthetic polypeptide"
EVQLQESGPGLVKPSETLSLTCTVSGSSIASDYWGWIRQFPGKGLEWIGFITYSGSTSYNPSLKSRVTISRDTSKNQFSLKLSSVTADDTAVYYCARMPSFITLASLSTWEGYFDFWGQGTMVTVSS

SEQ ID NO: 815 - protein, 5 aa, Artificial Sequence
  source: /note="Description of Artificial Sequence: Synthetic peptide"
SDYWG

SEQ ID NO: 816 - protein, 16 aa, Artificial Sequence
  source: /note="Description of Artificial Sequence: Synthetic peptide"
FITYSGSTSYNPSLKS

SEQ ID NO: 817 - protein, 19 aa, Artificial Sequence
  source: /note="Description of Artificial Sequence: Synthetic peptide"
MPSFITLASLSTWEGYFDF

SEQ ID NO: 818 - protein, 127 aa, Artificial Sequence
  source: /note="Description of Artificial Sequence: Synthetic polypeptide"
EVQLQESGPGLVKPSETLSLTCTVSGSSIASDYWGWIRKPPGKKMEWIGFITYSGSTSYNPSLKSRVTISVDTSKNQFSLKLSSVTAADTAVYYCARMPSFITLASLSTWEGYFDFWGQGTMVTVSS

SEQ ID NO: 819 - protein, 5 aa, Artificial Sequence
  source: /note="Description of Artificial Sequence: Synthetic peptide"
SDYWG

SEQ ID NO: 820 - protein, 16 aa, Artificial Sequence
  source: /note="Description of Artificial Sequence: Synthetic peptide"
FITYSGSTSYNPSLKS

SEQ ID NO: 821 - protein, 19 aa, Artificial Sequence
  source: /note="Description of Artificial Sequence: Synthetic peptide"
MPSFITLASLSTWEGYFDF

SEQ ID NO: 822 - protein, 127 aa, Artificial Sequence
  source: /note="Description of Artificial Sequence: Synthetic polypeptide"
EVQLQESGPGLVKPSETLSLTCSVTGSSIASDYWGWIRQPPGKGLEWIGFITYSGSTSYNPSLKSRVTISRDTSKNQFSLKLSSVTAADTAVYYCARMPSFITLASLSTWEGYFDFWGQGTMVTVSS

SEQ ID NO: 823 - protein, 5 aa, Artificial Sequence
  source: /note="Description of Artificial Sequence: Synthetic peptide"
SDYWG

SEQ ID NO: 824 - protein, 16 aa, Artificial Sequence
  source: /note="Description of Artificial Sequence: Synthetic peptide"
FITYSGSTSYNPSLKS

SEQ ID NO: 825 - protein, 19 aa, Artificial Sequence
  source: /note="Description of Artificial Sequence: Synthetic peptide"
MPSFITLASLSTWEGYFDF

SEQ ID NO: 826 - protein, 127 aa, Artificial Sequence
  source: /note="Description of Artificial Sequence: Synthetic polypeptide"
EVQLQQSGAGLLKPSETLSLTCSVTGSSIASDYWGWIRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 827 - protein, 5 aa, Artificial Sequence
  source: /note="Description of Artificial Sequence: Synthetic peptide"
SDYWG

SEQ ID NO: 828 - protein, 16 aa, Artificial Sequence
  source: /note="Description of Artificial Sequence: Synthetic peptide"
FITYSGSTSYNPSLKS

SEQ ID NO: 829 - protein, 19 aa, Artificial Sequence
  source: /note="Description of Artificial Sequence: Synthetic peptide"
MPSFITLASLSTWEGYFDF

SEQ ID NO: 830 - protein, 127 aa, Artificial Sequence
  source: /note="Description of Artificial Sequence: Synthetic polypeptide"
EVQLQESGPGLVKPPGTLSLTCSVTGSSIASDYWGWVRQPPGKGLEWIGFITYSGSTSYNPSLKSRVTISVDTSKNQFSLKLSSVTAADTAVYYCARMPSFITLASLSTWEGYFDFWGQGTMVTVSS

SEQ ID NO: 831 - protein, 5 aa, Artificial Sequence
  source: /note="Description of Artificial Sequence: Synthetic peptide"
SDYWG

SEQ ID NO: 832 - protein, 16 aa, Artificial Sequence
  source: /note="Description of Artificial Sequence: Synthetic peptide"
FITYSGSTSYNPSLKS

SEQ ID NO: 833 - protein, 19 aa, Artificial Sequence
  source: /note="Description of Artificial Sequence: Synthetic peptide"
MPSFITLASLSTWEGYFDF

SEQ ID NO: 834 - protein, 127 aa, Artificial Sequence
  source: /note="Description of Artificial Sequence: Synthetic polypeptide"
EVQLQESGPGLVKPSETLSLTCAVSGSSISSDYWGWIRQPPGKGLEWIGFITYSGSTSYNPSLKSRITISRDTSKNQFSLKLHSVTAADTAVYYCARMPSFITLASLSTWEGYFDFWGQGTMVTVSS

SEQ ID NO: 835 - protein, 5 aa, Artificial Sequence
  source: /note="Description of Artificial Sequence: Synthetic peptide"
SDYWG

SEQ ID NO: 836 - protein, 16 aa, Artificial Sequence
  source: /note="Description of Artificial Sequence: Synthetic peptide"
FITYSGSTSYNPSLKS

SEQ ID NO: 837 - protein, 19 aa, Artificial Sequence
  source: /note="Description of Artificial Sequence: Synthetic peptide"
MPSFITLASLSTWEGYFDF

SEQ ID NO: 838 - protein, 127 aa, Artificial Sequence
  source: /note="Description of Artificial Sequence: Synthetic polypeptide"
EVQLQESGPGLVKPSETLSLTCAVSGSSISSDYWGWIRQPPGKGLEWMGFITYSGSTSYNPSLKSRITISRDTSKNQFSLKLHSVTAADTAVYYCARMPSFITLASLSTWEGYFDFWGQGTMVTVSS

SEQ ID NO: 839 - protein, 5 aa, Artificial Sequence
  source: /note="Description of Artificial Sequence: Synthetic peptide"
SDYWG

SEQ ID NO: 840 - protein, 16 aa, Artificial Sequence
  source: /note="Description of Artificial Sequence: Synthetic peptide"
FITYSGSTSYNPSLKS

SEQ ID NO: 841 - protein, 19 aa, Artificial Sequence
  source: /note="Description of Artificial Sequence: Synthetic peptide"
MPSFITLASLSTWEGYFDF

SEQ ID NO: 842 - protein, 106 aa, Artificial Sequence
  source: /note="Description of Artificial Sequence: Synthetic polypeptide"
DIQMTQSPSSLSASVGDRVTITCKASQSIHKNLAWYQQKPGKAPKLLIYYANSLQTGVPSRFSGSGSGTDFTLTISSLQPEDFATYYCQQYYSGWTFGGGTKVEIK

SEQ ID NO: 843 - protein, 12 aa, Artificial Sequence
  source: /note="Description of Artificial Sequence: Synthetic peptide"
KASQSIHKNLAW

SEQ ID NO: 844 - protein, 7 aa, Artificial Sequence
  source: /note="Description of Artificial Sequence: Synthetic peptide"
YANSLQT

SEQ ID NO: 845 - protein, 8 aa, Artificial Sequence
  source: /note="Description of Artificial Sequence: Synthetic peptide"
QQYYSGWT

SEQ ID NO: 846 - protein, 106 aa, Artificial Sequence
  source: /note="Description of Artificial Sequence: Synthetic polypeptide"
DIQMTQSPSSLSASVGDRVTITCKASQSIHKNLAWYQQKPGKAPKFLIYYANSLQTGVPSRFSGSGSGTDFTLTISSLQPEDFATYYCQQYYSGWTFGGGTKVEIK

SEQ ID NO: 847 - protein, 12 aa, Artificial Sequence
  source: /note="Description of Artificial Sequence: Synthetic peptide"
KASQSIHKNLAW

SEQ ID NO: 848 - protein, 7 aa, Artificial Sequence
  source: /note="Description of Artificial Sequence: Synthetic peptide"
YANSLQT

SEQ ID NO: 849 - protein, 8 aa, Artificial Sequence
  source: /note="Description of Artificial Sequence: Synthetic peptide"
QQYYSGWT

SEQ ID NO: 850 - protein, 106 aa, Artificial Sequence
  source: /note="Description of Artificial Sequence: Synthetic polypeptide"
DIQMTQSPSSLSASVGDRVTITCKASQSIHKNLAWYQQKPGKAPKFLIYYANSLQTGIPSRFSGSGSGTDFTLTISSLQPEDFATYYCQQYYSGWTFGGGTKVEIK

SEQ ID NO: 851 - protein, 12 aa, Artificial Sequence
  source: /note="Description of Artificial Sequence: Synthetic peptide"
KASQSIHKNLAW

SEQ ID NO: 852 - protein, 7 aa, Artificial Sequence
  source: /note="Description of Artificial Sequence: Synthetic peptide"
YANSLQT

SEQ ID NO: 853 - protein, 8 aa, Artificial Sequence
  source: /note="Description of Artificial Sequence: Synthetic peptide"
QQYYSGWT

SEQ ID NO: 854 - protein, 106 aa, Artificial Sequence
  source: /note="Description of Artificial Sequence: Synthetic polypeptide"
DIQMTQSPSSLSASVGDRVTITCKASQSIHKNLAWYQQKPGKVPKLLIYYANSLQTGVPSRFSGSGSGTDFTLTISSLQPEDVATYYCQQYYSGWTFGGGTKVEIK

SEQ ID NO: 855 - protein, 12 aa, Artificial Sequence
  source: /note="Description of Artificial Sequence: Synthetic peptide"
KASQSIHKNLAW

SEQ ID NO: 856 - protein, 7 aa, Artificial Sequence
  source: /note="Description of Artificial Sequence: Synthetic peptide"
YANSLQT

SEQ ID NO: 857 - protein, 8 aa, Artificial Sequence
  source: /note="Description of Artificial Sequence: Synthetic peptide"
QQYYSGWT

SEQ ID NO: 858 - protein, 106 aa, Artificial Sequence
  source: /note="Description of Artificial Sequence: Synthetic polypeptide"
DIQMTQSPSSLSASVGDRVTITCKASQSIHKNLAWYQQKPGKVPKFLIYYANSLQTGVPSRFSGSGSGTDFTLTISSLQPEDVATYYCQQYYSGWTFGGGTKVEIK

SEQ ID NO: 859 - protein, 12 aa, Artificial Sequence
  source: /note="Description of Artificial Sequence: Synthetic peptide"
KASQSIHKNLAW

SEQ ID NO: 860 - protein, 7 aa, Artificial Sequence
  source: /note="Description of Artificial Sequence: Synthetic peptide"
YANSLQT

SEQ ID NO: 861 - protein, 8 aa, Artificial Sequence
  source: /note="Description of Artificial Sequence: Synthetic peptide"
QQYYSGWT

SEQ ID NO: 862 - protein, 106 aa, Artificial Sequence
  source: /note="Description of Artificial Sequence: Synthetic polypeptide"
DIQMTQSPSSLSASVGDRVTITCKASQSIHKNLAWYQQKPGKVPKFLIYYANSLQTGIPSRFSGSGSGTDFTLTISSLQPEDVATYYCQQYYSGWTFGGGTKVEIK

SEQ ID NO: 863 - protein, 12 aa, Artificial Sequence
  source: /note="Description of Artificial Sequence: Synthetic peptide"
KASQSIHKNLAW

SEQ ID NO: 864 - protein, 7 aa, Artificial Sequence
  source: /note="Description of Artificial Sequence: Synthetic peptide"
YANSLQT

SEQ ID NO: 865 - protein, 8 aa, Artificial Sequence
  source: /note="Description of Artificial Sequence: Synthetic peptide"
QQYYSGWT

SEQ ID NO: 866 - protein, 106 aa, Artificial Sequence; identical to SEQ ID NO: 842
  source: /note="Description of Artificial Sequence: Synthetic polypeptide"

SEQ ID NO: 867 - protein, 12 aa, Artificial Sequence
  source: /note="Description of Artificial Sequence: Synthetic peptide"
KASQSIHKNLAW

SEQ ID NO: 868 - protein, 7 aa, Artificial Sequence
  source: /note="Description of Artificial Sequence: Synthetic peptide"
YANSLQT

SEQ ID NO: 869 - protein, 8 aa, Artificial Sequence
  source: /note="Description of Artificial Sequence: Synthetic peptide"
QQYYSGWT

SEQ ID NO: 870 - protein, 106 aa, Artificial Sequence; identical to SEQ ID NO: 846
  source: /note="Description of Artificial Sequence: Synthetic polypeptide"

SEQ ID NO: 871 - protein, 12 aa, Artificial Sequence
  source: /note="Description of Artificial Sequence: Synthetic peptide"
KASQSIHKNLAW

SEQ ID NO: 872 - protein, 7 aa, Artificial Sequence
  source: /note="Description of Artificial Sequence: Synthetic peptide"
YANSLQT

SEQ ID NO: 873 - protein, 8 aa, Artificial Sequence
  source: /note="Description of Artificial Sequence: Synthetic peptide"
QQYYSGWT

SEQ ID NO: 874 - protein, 106 aa, Artificial Sequence
  source: /note="Description of Artificial Sequence: Synthetic polypeptide"
DIQMTQSPSSLSASVGDRVTITCKASQSIHKNLAWYQQKPGKAPKLLIYYANSLQTGVPSRFSGSGSGTDFTLTISSLQPEDFATYFCQQYYSGWTFGGGTKVEIK

SEQ ID NO: 875 - protein, 12 aa, Artificial Sequence
  source: /note="Description of Artificial Sequence: Synthetic peptide"
KASQSIHKNLAW

SEQ ID NO: 876 - protein, 7 aa, Artificial Sequence
  source: /note="Description of Artificial Sequence: Synthetic peptide"
YANSLQT

SEQ ID NO: 877 - protein, 8 aa, Artificial Sequence
  source: /note="Description of Artificial Sequence: Synthetic peptide"
QQYYSGWT

SEQ ID NO: 878 - protein, 106 aa, Artificial Sequence
  source: /note="Description of Artificial Sequence: Synthetic polypeptide"
DIQMTQSPSSLSASVGDRVTITCKASQSIHKNLAWYQQKPGKAPKFLIYYANSLQTGVPSRFSGSGSGTDFTLTISSLQPEDFATYFCQQYYSGWTFGGGTKVEIK

SEQ ID NO: 879 - protein, 12 aa, Artificial Sequence
  source: /note="Description of Artificial Sequence: Synthetic peptide"
KASQSIHKNLAW

SEQ ID NO: 880 - protein, 7 aa, Artificial Sequence
  source: /note="Description of Artificial Sequence: Synthetic peptide"
YANSLQT

SEQ ID NO: 881 - protein, 8 aa, Artificial Sequence
  source: /note="Description of Artificial Sequence: Synthetic peptide"
QQYYSGWT

SEQ ID NO: 882 - protein, 106 aa, Artificial Sequence
  source: /note="Description of Artificial Sequence: Synthetic polypeptide"
DIQMTQSPSSLSASVGDRVTITCKASQSIHKNLAWYQQKPGKAPKLLIYYANSLQTGIPSRFSGSGSGTDFTLTISSLQPEDFATYYCQQYYSGWTFGGGTKVEIK

SEQ ID NO: 883 - protein, 12 aa, Artificial Sequence
  source: /note="Description of Artificial Sequence: Synthetic peptide"
KASQSIHKNLAW

SEQ ID NO: 884 - protein, 7 aa, Artificial Sequence
  source: /note="Description of Artificial Sequence: Synthetic peptide"
YANSLQT

SEQ ID NO: 885 - protein, 8 aa, Artificial Sequence
  source: /note="Description of Artificial Sequence: Synthetic peptide"
QQYYSGWT

SEQ ID NO: 886 - protein, 121 aa, Artificial Sequence
  source: /note="Description of Artificial Sequence: Synthetic polypeptide"
DVQLQESGPGLVKPSQSLSLTCTVTGYSITSDYAWNWIRQFPGNKLEWMGYISNSGSASYNPSLKSRISITRDTSKNQFFLQLNSVTTEDTATYYCATLIYYDYGGAMNFWGQGTSVTVSS

SEQ ID NO: 887 - protein, 11 aa, Artificial Sequence
  source: /note="Description of Artificial Sequence: Synthetic peptide"
GYSITSDYAWN

SEQ ID NO: 888 - protein, 16 aa, Artificial Sequence
  source: /note="Description of Artificial Sequence: Synthetic peptide"
YISNSGSASYNPSLKS

SEQ ID NO: 889 - protein, 12 aa, Artificial Sequence
  source: /note="Description of Artificial Sequence: Synthetic peptide"
LIYYDYGGAMNF

SEQ ID NO: 890 - protein, 107 aa, Artificial Sequence
  source: /note="Description of Artificial Sequence: Synthetic polypeptide"
DIVMTQSHKFMSTSVGDRVSITCKASQGVSTTVAWYQQKPGQSPKLLIYSASYRYTGVPDRFTGSGSGTDFTFTISSVQSEDLAVYYCQHYYSTPWTFGGGTKLEIK

SEQ ID NO: 891 - protein, 11 aa, Artificial Sequence
  source: /note="Description of Artificial Sequence: Synthetic peptide"
KASQGVSTTVA

SEQ ID NO: 892 - protein, 7 aa, Artificial Sequence
  source: /note="Description of Artificial Sequence: Synthetic peptide"
SASYRYT

SEQ ID NO: 893 - protein, 9 aa, Artificial Sequence
  source: /note="Description of Artificial Sequence: Synthetic peptide"
QHYYSTPWT

SEQ ID NO: 894 - protein, 7 aa, Artificial Sequence
  source: /note="Description of Artificial Sequence: Synthetic peptide"
YASNLQT

SEQ ID NO: 895 - protein, 7 aa, Artificial Sequence
  source: /note="Description of Artificial Sequence: Synthetic peptide"
YASSLQT

SEQ ID NO: 896 - protein, 7 aa, Artificial Sequence
  source: /note="Description of Artificial Sequence: Synthetic peptide"
YASTLQT

SEQ ID NO: 897 - protein, 7 aa, Artificial Sequence
  source: /note="Description of Artificial Sequence: Synthetic peptide"
YATTLQT

SEQ ID NO: 898 - protein, 7 aa, Artificial Sequence
  source: /note="Description of Artificial Sequence: Synthetic peptide"
YASYLQT

SEQ ID NO: 899 - protein, 7 aa, Artificial Sequence
  source: /note="Description of Artificial Sequence: Synthetic peptide"
YANQLQT

SEQ ID NO: 900 - protein, 7 aa, Artificial Sequence
  source: /note="Description of Artificial Sequence: Synthetic peptide"
YAGSLQT

SEQ ID NO: 901 - protein, 7 aa, Artificial Sequence
  source: /note="Description of Artificial Sequence: Synthetic peptide"
YASQLQT

SEQ ID NO: 902 - protein, 7 aa, Artificial Sequence
  source: /note="Description of Artificial Sequence: Synthetic peptide"
YADSLQT

SEQ ID NO: 903 - protein, 107 aa, Artificial Sequence; identical to SEQ ID NO: 890
  source: /note="Description of Artificial Sequence: Synthetic polypeptide"

SEQ ID NO: 904 - protein, 11 aa, Artificial Sequence
  source: /note="Description of Artificial Sequence: Synthetic peptide"
KASQGVSTTVA

SEQ ID NO: 905 - protein, 7 aa, Artificial Sequence
  source: /note="Description of Artificial Sequence: Synthetic peptide"
SASYRYT

SEQ ID NO: 906 - protein, 9 aa, Artificial Sequence
  source: /note="Description of Artificial Sequence: Synthetic peptide"
QHYYSTPWT

SEQ ID NO: 907 - protein, 8 aa, Artificial Sequence
  source: /note="Description of Artificial Sequence: Synthetic peptide"
QQYYSGFT

SEQ ID NO: 908 - protein, 8 aa, Artificial Sequence
  source: /note="Description of Artificial Sequence: Synthetic peptide"
QQYYSGYT

SEQ ID NO: 909 - protein, 8 aa, Artificial Sequence
  source: /note="Description of Artificial Sequence: Synthetic peptide"
QQYYSGIT

SEQ ID NO: 910 - protein, 8 aa, Artificial Sequence
  source: /note="Description of Artificial Sequence: Synthetic peptide"
QQYYSGVT

SEQ ID NO: 911 - protein, 8 aa, Artificial Sequence
  source: /note="Description of Artificial Sequence: Synthetic peptide"
QQYYSGLT

SEQ ID NO: 912 - protein, 121 aa, Artificial Sequence; identical to SEQ ID NO: 886
  source: /note="Description of Artificial Sequence: Synthetic polypeptide"

SEQ ID NO: 913 - protein, 11 aa, Artificial Sequence
  source: /note="Description of Artificial Sequence: Synthetic peptide"
GYSITSDYAWN

SEQ ID NO: 914 - protein, 16 aa, Artificial Sequence
  source: /note="Description of Artificial Sequence: Synthetic peptide"
YISNSGSASYNPSLKS

SEQ ID NO: 915 - protein, 12 aa, Artificial Sequence
  source: /note="Description of Artificial Sequence: Synthetic peptide"
LIYYDYGGAMNF

SEQ ID NO: 916 - protein, 19 aa, Artificial Sequence
  source: /note="Description of Artificial Sequence: Synthetic peptide"
MPSFITLASLSTFEGYFDF

SEQ ID NO: 917 - protein, 19 aa, Artificial Sequence
  source: /note="Description of Artificial Sequence: Synthetic peptide"
MPSFITLASLSTYEGYFDF

SEQ ID NO: 918 - protein, 19 aa, Artificial Sequence
  source: /note="Description of Artificial Sequence: Synthetic peptide"
MPSFITLASLSTIEGYFDF

SEQ ID NO: 919 - protein, 19 aa, Artificial Sequence
  source: /note="Description of Artificial Sequence: Synthetic peptide"
MPSFITLASLSTVEGYFDF

SEQ ID NO: 920 - protein, 19 aa, Artificial Sequence
  source: /note="Description of Artificial Sequence: Synthetic peptide"
MPSFITLASLSTLEGYFDF

SEQ ID NO: 921 - protein, 119 aa, Artificial Sequence; identical to SEQ ID NO: 126
  source: /note="Description of Artificial Sequence: Synthetic polypeptide"

SEQ ID NO: 922 - protein, 5 aa, Artificial Sequence
  source: /note="Description of Artificial Sequence: Synthetic peptide"
SYVMH

SEQ ID NO: 923 - protein, 16 aa, Artificial Sequence
  source: /note="Description of Artificial Sequence: Synthetic peptide"
YIDPYNDGAKYNEKFK

SEQ ID NO: 924 - protein, 9 aa, Artificial Sequence
  source: /note="Description of Artificial Sequence: Synthetic peptide"
GPYGWYFDV

SEQ ID NO: 925 - protein, 16 aa, Artificial Sequence
  source: /note="Description of Artificial Sequence: Synthetic peptide"
YIDPYNRGAKYNEKFG

SEQ ID NO: 926 - protein, 16 aa, Artificial Sequence
  source: /note="Description of Artificial Sequence: Synthetic peptide"
YIDPYNLGAKYNEKFG

SEQ ID NO: 927 - protein, 16 aa, Artificial Sequence
  source: /note="Description of Artificial Sequence: Synthetic peptide"
YIDPYNKGAKYNEKFG

SEQ ID NO: 928 - protein, 16 aa, Artificial Sequence
  source: /note="Description of Artificial Sequence: Synthetic peptide"
YIDPYNFGAKYNEKFG

SEQ ID NO: 929 - protein, 16 aa, Artificial Sequence
  source: /note="Description of Artificial Sequence: Synthetic peptide"
YIDPYNSGAKYNEKFG

SEQ ID NO: 930 - protein, 16 aa, Artificial Sequence
  source: /note="Description of Artificial Sequence: Synthetic peptide"
YIDPYNYGAKYNEKFG

SEQ ID NO: 931 - protein, 16 aa, Artificial Sequence
  source: /note="Description of Artificial Sequence: Synthetic peptide"
YIDPYNVGAKYNEKFG

SEQ ID NO: 932 - protein, 17 aa, Artificial Sequence
  source: /note="Description of Artificial Sequence: Synthetic peptide"
YIDPYNDRAKYNEKFKG

SEQ ID NO: 933 - protein, 17 aa, Artificial Sequence
  source: /note="Description of Artificial Sequence: Synthetic peptide"
YIDPYNDNAKYNEKFKG

SEQ ID NO: 934 - protein, 17 aa, Artificial Sequence
  source: /note="Description of Artificial Sequence: Synthetic peptide"
YIDPYNDQAKYNEKFKG

SEQ ID NO: 935 - protein, 17 aa, Artificial Sequence
  source: /note="Description of Artificial Sequence: Synthetic peptide"
YIDPYNDEAKYNEKFKG

SEQ ID NO: 936 - protein, 17 aa, Artificial Sequence
  source: /note="Description of Artificial Sequence: Synthetic peptide"
YIDPYNDLAKYNEKFKG

SEQ ID NO: 937 - protein, 17 aa, Artificial Sequence
  source: /note="Description of Artificial Sequence: Synthetic peptide"
YIDPYNDKAKYNEKFKG

SEQ ID NO: 938 - protein, 17 aa, Artificial Sequence
  source: /note="Description of Artificial Sequence: Synthetic peptide"
YIDPYNDSAKYNEKFKG

SEQ ID NO: 939 - protein, 17 aa, Artificial Sequence
  source: /note="Description of Artificial Sequence: Synthetic peptide"
YIDPYNDYAKYNEKFKG

SEQ ID NO: 940 - protein, 17 aa, Artificial Sequence
  source: /note="Description of Artificial Sequence: Synthetic peptide"
YIDPYNDVAKYNEKFKG

SEQ ID NO: 941 - protein, 107 aa, Artificial Sequence; identical to SEQ ID NO: 131
  source: /note="Description of Artificial Sequence: Synthetic polypeptide"

SEQ ID NO: 942 - protein, 11 aa, Artificial Sequence
  source: /note="Description of Artificial Sequence: Synthetic peptide"
RASEHIYSYLS

SEQ ID NO: 943 - protein, 7 aa, Artificial Sequence
  source: /note="Description of Artificial Sequence: Synthetic peptide"
NAKTLAE

SEQ ID NO: 944 - protein, 9 aa, Artificial Sequence
  source: /note="Description of Artificial Sequence: Synthetic peptide"
QHHFGSPLT

SEQ ID NO: 945 - protein, 7 aa, Artificial Sequence
  source: /note="Description of Artificial Sequence: Synthetic peptide"
AAKTLAE

SEQ ID NO: 946 - protein, 7 aa, Artificial Sequence
  source: /note="Description of Artificial Sequence: Synthetic peptide"
YAKTLAE

SEQ ID NO: 947 - protein, 7 aa, Artificial Sequence
  source: /note="Description of Artificial Sequence: Synthetic peptide"
WAKTLAE

SEQ ID NO: 948 - protein, 7 aa, Artificial Sequence
  source: /note="Description of Artificial Sequence: Synthetic peptide"
SAKTLAE

SEQ ID NO: 949 - protein, 7 aa, Artificial Sequence
  source: /note="Description of Artificial Sequence: Synthetic peptide"
TAKTLAE

SEQ ID NO: 950 - protein, 7 aa, Artificial Sequence
  source: /note="Description of Artificial Sequence: Synthetic peptide"
IAKTLAE

SEQ ID NO: 951 - protein, 7 aa, Artificial Sequence
  source: /note="Description of Artificial Sequence: Synthetic peptide"
VAKTLAE

SEQ ID NO: 952 - protein, 7 aa, Artificial Sequence
  source: /note="Description of Artificial Sequence: Synthetic peptide"
NNKTLAE

SEQ ID NO: 953 - protein, 7 aa, Artificial Sequence
  source: /note="Description of Artificial Sequence: Synthetic peptide"
NIKTLAE

SEQ ID NO: 954 - protein, 7 aa, Artificial Sequence
  source: /note="Description of Artificial Sequence: Synthetic peptide"
NLLTLAE

SEQ ID NO: 955 - protein, 7 aa, Artificial Sequence
  source: /note="Description of Artificial Sequence: Synthetic peptide"
NTKTLAE

SEQ ID NO: 956 - protein, 7 aa, Artificial Sequence
  source: /note="Description of Artificial Sequence: Synthetic peptide"
NVKTLAE

SEQ ID NO: 957 - protein, 119 aa, Artificial Sequence
  source: /note="Description of Artificial Sequence: Synthetic polypeptide"
EVQLVQSGAEVKKPGASVKVSCKASGYTFSSYVMHWVRQAPGQRLEWIGYIDPYNDGAKYSQKFQGRVTLTRDTSASTAYMELSSLRSEDTAVYYCARGGPYGWYFDVWGQGTTVTVSS

SEQ ID NO: 958 - protein, 6 aa, Artificial Sequence
  source: /note="Description of Artificial Sequence: Synthetic peptide"
SYVMHW

SEQ ID NO: 959 - protein, 16 aa, Artificial Sequence
  source: /note="Description of Artificial Sequence: Synthetic peptide"
YIDPYNDGAKYSQKFQ

SEQ ID NO: 960 - protein, 10 aa, Artificial Sequence
  source: /note="Description of Artificial Sequence: Synthetic peptide"
GGPYGWYFDV

SEQ ID NO: 961 - protein, 119 aa, Artificial Sequence
  source: /note="Description of Artificial Sequence: Synthetic polypeptide"
EVQLVQSGAEVKKPGASVKVSCKASGYTFSSYVMHWVRQAPGQRLEWIGYIDPYNDGAKYSQKFQGRVTLTSDKSASTAYMELSSLRSEDTAVYYCARGGPYGWYFDVWGQGTTVTVSS

SEQ ID NO: 962 - protein, 5 aa, Artificial Sequence
  source: /note="Description of Artificial Sequence: Synthetic peptide"
SYVMH

SEQ ID NO: 963 - protein, 16 aa, Artificial Sequence
  source: /note="Description of Artificial Sequence: Synthetic peptide"
YIDPYNDGAKYSQKFQ

SEQ ID NO: 964 - protein, 10 aa, Artificial Sequence
  source: /note="Description of Artificial Sequence: Synthetic peptide"
GGPYGWYFDV

SEQ ID NO: 965 - protein, 119 aa, Artificial Sequence
  source: /note="Description of Artificial Sequence: Synthetic polypeptide"
EVQLVQSGAEVKKPGASVKVSCKASGYTFSSYVMHWVRQAPGQGLEWIGYIDPYNDGAKYAQKFQGRVTLTRDTSTSTVYMELSSLRSEDTAVYYCARGGPYGWYFDVWGQGTTVTVSS

SEQ ID NO: 966 - protein, 5 aa, Artificial Sequence
  source: /note="Description of Artificial Sequence: Synthetic peptide"
SYVMH

SEQ ID NO: 967 - protein, 13 aa, Artificial Sequence
  source: /note="Description of Artificial Sequence: Synthetic peptide"
YIDPYNDGAKYAQ

SEQ ID NO: 968 - protein, 10 aa, Artificial Sequence
  source: /note="Description of Artificial Sequence: Synthetic peptide"
GGPYGWYFDV

SEQ ID NO: 969 - protein, 119 aa, Artificial Sequence
  source: /note="Description of Artificial Sequence: Synthetic polypeptide"
EVQLVQSGAEVKKPGASVKVSCKASGYTFSSYVMHWVRQAPGQGLEWIGYIDPYNDGAKYAQKFQGRVTLTSDKSTSTVYMELSSLRSEDTAVYYCARGGPYGWYFDVWGQGTTVTVSS

SEQ ID NO: 970 - protein, 5 aa, Artificial Sequence
  source: /note="Description of Artificial Sequence: Synthetic peptide"
SYVMH

SEQ ID NO: 971 - protein, 16 aa, Artificial Sequence
  source: /note="Description of Artificial Sequence: Synthetic peptide"
YIDPYNDGAKYAQKFQ

SEQ ID NO: 972 - protein, 10 aa, Artificial Sequence
  source: /note="Description of Artificial Sequence: Synthetic peptide"
GGPYGWYFDV

SEQ ID NO: 973 - protein, 119 aa, Artificial Sequence
  source: /note="Description of Artificial Sequence: Synthetic polypeptide"
EVQLVQSGAEVKKPGSSVKVSCKASGYTFSSYVMHWVRQAPGQGLEWIGYIDPYNDGAKYAQKFQGRVTLTSDKSTSTAYMELSSLRSEDTAVYYCARGGPYGWYFDVWGQGTTVTVSS

SEQ ID NO: 974 - protein, 5 aa, Artificial Sequence
  source: /note="Description of Artificial Sequence: Synthetic peptide"
SYVMH

SEQ ID NO: 975 - protein, 16 aa, Artificial Sequence
  source: /note="Description of Artificial Sequence: Synthetic peptide"
YIDPYNDGAKYAQKFQ

SEQ ID NO: 976 - protein, 10 aa, Artificial Sequence
  source: /note="Description of Artificial Sequence: Synthetic peptide"
GGPYGWYFDV

SEQ ID NO: 977 - protein, 119 aa, Artificial Sequence
  source: /note="Description of Artificial Sequence: Synthetic polypeptide"
EVQLVQSGAEVKKPGASVKVSCKASGYTFSSYVMHWVRQAPGQGLEWIGYIDPYNDGAKYAQKFQGRVTLTSDKSISTAYMELSRLRSDDTVVYYCARGGPYGWYFDVWGQGTTVTVSS

SEQ ID NO: 978 - protein, 5 aa, Artificial Sequence
  source: /note="Description of Artificial Sequence: Synthetic peptide"
SYVMH

SEQ ID NO: 979 - protein, 16 aa, Artificial Sequence
  source: /note="Description of Artificial Sequence: Synthetic peptide"
YIDPYNDGAKYAQKFQ

SEQ ID NO: 980 - protein, 10 aa, Artificial Sequence
  source: /note="Description of Artificial Sequence: Synthetic peptide"
GGPYGWYFDV

SEQ ID NO: 981 - protein, 107 aa, Artificial Sequence
  source: /note="Description of Artificial Sequence: Synthetic polypeptide"
DIQMTQSPSSLSASVGDRVTITCRASEHIYSYLSWYQQKPGKAPKLLIYNAKTLAEGVPSRFSGSGSGTDFTLTISSLQPEDFATYYCQHHFGSPLTFGQGTRLEIK

SEQ ID NO: 982 - protein, 11 aa, Artificial Sequence
  source: /note="Description of Artificial Sequence: Synthetic peptide"
RASEHIYSYLS

SEQ ID NO: 983 - protein, 7 aa, Artificial Sequence
  source: /note="Description of Artificial Sequence: Synthetic peptide"
NAKTLAE

SEQ ID NO: 984 - protein, 9 aa, Artificial Sequence
  source: /note="Description of Artificial Sequence: Synthetic peptide"
QHHFGSPLT

SEQ ID NO: 985 - protein, 107 aa, Artificial Sequence
  source: /note="Description of Artificial Sequence: Synthetic polypeptide"
DIQMTQSPSSLSASVGDRVTITCRASEHIYSYLSWYQQKPGKAPKLLIYNAKTLAEGVPSRFSGSGSGTQFTLTISSLQPEDFATYYCQHHFGSPLTFGQGTRLEIK

SEQ ID NO: 986 - protein, 11 aa, Artificial Sequence
  source: /note="Description of Artificial Sequence: Synthetic peptide"
RASEHIYSYLS

SEQ ID NO: 987 - protein, 7 aa, Artificial Sequence
  source: /note="Description of Artificial Sequence: Synthetic peptide"
NAKTLAE

SEQ ID NO: 988 - protein, 9 aa, Artificial Sequence
  source: /note="Description of Artificial Sequence: Synthetic peptide"
QHHFGSPLT

SEQ ID NO: 989 - protein, 107 aa, Artificial Sequence
  source: /note="Description of Artificial Sequence: Synthetic polypeptide"
DIQMTQSPSSLSASVGDRVTITCRASEHIYSYLSWYQQKPGKVPKLLIYNAKTLAEGVPSRFSGSGSGTDFTLTISSLQPEDVATYYCQHHFGSPLTFGQGTRLEIK

SEQ ID NO: 990 - protein, 11 aa, Artificial Sequence
  source: /note="Description of Artificial Sequence: Synthetic peptide"
RASEHIYSYLS

SEQ ID NO: 991 - protein, 7 aa, Artificial Sequence
  source: /note="Description of Artificial Sequence: Synthetic peptide"
NAKTLAE

SEQ ID NO: 992 - protein, 9 aa, Artificial Sequence
  source: /note="Description of Artificial Sequence: Synthetic peptide"
QHHFGSPLT

SEQ ID NO: 993 - protein, 107 aa, Artificial Sequence
  source: /note="Description of Artificial Sequence: Synthetic polypeptide"
DIQMTQSPSSLSASVGDRVTITCRASEHIYSYLSWYQQKPGKVPKLLIYNAKTLAEGVPSRFSGSGSGTQFTLTISSLQPEDVATYYCQHHFGSPLTFGQGTRLEIK

SEQ ID NO: 994 - protein, 11 aa, Artificial Sequence
  source: /note="Description of Artificial Sequence: Synthetic peptide"
RASEHIYSYLS

SEQ ID NO: 995 - protein, 7 aa, Artificial Sequence
  source: /note="Description of Artificial Sequence: Synthetic peptide"
NAKTLAE

SEQ ID NO: 996 - protein, 9 aa, Artificial Sequence
  source: /note="Description of Artificial Sequence: Synthetic peptide"
QHHFGSPLT

SEQ ID NO: 997 - protein, 119 aa, Artificial Sequence; identical to SEQ ID NO: 977
  source: /note="Description of Artificial Sequence: Synthetic polypeptide"

SEQ ID NO: 998 - protein, 17 aa, Artificial Sequence
  source: /note="Description of Artificial Sequence: Synthetic peptide"
YIDPYNDGAKYAQKFQG

SEQ ID NO: 999 - protein, 17 aa, Artificial Sequence
  source: /note="Description of Artificial Sequence: Synthetic peptide"
YIDPYNDGAKYSQKFQG

SEQ ID NO: 1000 - protein, 119 aa, Artificial Sequence; identical to SEQ ID NO: 977
  source: /note="Description of Artificial Sequence: Synthetic polypeptide"

SEQ ID NO: 1001 - protein, 10 aa, Artificial Sequence
  source: /note="Description of Artificial Sequence: Synthetic peptide"
GGPYGAYFDV

SEQ ID NO: 1002 - protein, 10 aa, Artificial Sequence
  source: /note="Description of Artificial Sequence: Synthetic peptide"
GGPYGDYFDV

SEQ ID NO: 1003 - protein, 10 aa, Artificial Sequence
  source: /note="Description of Artificial Sequence: Synthetic peptide"
GGPYGEYFDV

SEQ ID NO: 1004 - protein, 10 aa, Artificial Sequence
  source: /note="Description of Artificial Sequence: Synthetic peptide"
GGPYGFYFDV

SEQ ID NO: 1005 - protein, 10 aa, Artificial Sequence
  source: /note="Description of Artificial Sequence: Synthetic peptide"
GGPYGGYFDV

SEQ ID NO: 1006 - protein, 10 aa, Artificial Sequence
  source: /note="Description of Artificial Sequence: Synthetic peptide"
GGPYGIYFDV

SEQ ID NO: 1007 - protein, 10 aa, Artificial Sequence
  source: /note="Description of Artificial Sequence: Synthetic peptide"
GGPYGKYFDV

SEQ ID NO: 1008 - protein, 10 aa, Artificial Sequence
  source: /note="Description of Artificial Sequence: Synthetic peptide"
GGPYGNYFDV

SEQ ID NO: 1009 - protein, 10 aa, Artificial Sequence
  source: /note="Description of Artificial Sequence: Synthetic peptide"
GGPYGQYFDV

SEQ ID NO: 1010 - protein, 10 aa, Artificial Sequence
  source: /note="Description of Artificial Sequence: Synthetic peptide"
GGPYGRYFDV

SEQ ID NO: 1011 - protein, 10 aa, Artificial Sequence
  source: /note="Description of Artificial Sequence: Synthetic peptide"
GGPYGSYFDV

SEQ ID NO: 1012 - protein, 10 aa, Artificial Sequence
  source: /note="Description of Artificial Sequence: Synthetic peptide"
GGPYGTYFDV

SEQ ID NO: 1013 - protein, 10 aa, Artificial Sequence
  source: /note="Description of Artificial Sequence: Synthetic peptide"
GGPYGVYFDV

SEQ ID NO: 1014 - protein, 10 aa, Artificial Sequence
  source: /note="Description of Artificial Sequence: Synthetic peptide"
GGPYGYYFDV

SEQ ID NO: 1015 - protein, 116 aa, Artificial Sequence
  source: /note="Description of Artificial Sequence: Synthetic polypeptide"
QVQLMESGPGLVQPSQTLSLTCTVSGFPLTSYTVHWVRQPPGKGLEWIGAIWSSGSTDYNSALKSRLNINRDSSKSQVFLKMNSLQTEDTAIYFCTKSGWAFFDYWGQGVMVTVSS

SEQ ID NO: 1016 - protein, 106 aa, Artificial Sequence
  source: /note="Description of Artificial Sequence: Synthetic polypeptide"
DIQMTQSPSLLSASVGDRVTLNCIASQNIYKSLAWYQLKLGEAPKLLIYNANSLQAGIPSRFSGSGSGTDFALTISGLQPEDVATYFCQQYSGGYTFGAGTKLELK

SEQ ID NO: 1017 - protein, 119 aa, Artificial Sequence
  source: /note="Description of Artificial Sequence: Synthetic polypeptide"
EVQLVESGGDLVQPGRSLKISCVASGFTFSDYYMAWVRLAPQKGLEWVASISYEGSRTHYGDSVRGRFIISRDNPKNILYLQMNSLGSEDTATYFCARHTGTLDWLVYWGQGTLVIVSS

SEQ ID NO: 1018 - protein, 106 aa, Artificial Sequence
  source: /note="Description of Artificial Sequence: Synthetic polypeptide"
NIVMAQSPKSMSISAGDRVTMNCKASQNVDNNIAWYQQKPGQSPKLLIFYASNRYSGVPDRFTGGGYGTDFTLTIKSVQAEDAAFYYCQRIYNFPTFGSGTKLEIK

SEQ ID NO: 1019 - protein, 120 aa, Artificial Sequence
  source: /note="Description of Artificial Sequence: Synthetic polypeptide"
QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSS

SEQ ID NO: 1020 - protein, 8 aa, Artificial Sequence
  source: /note="Description of Artificial Sequence: Synthetic peptide"
GYTFTDYN

SEQ ID NO: 1021 - protein, 8 aa, Artificial Sequence
  source: /note="Description of Artificial Sequence: Synthetic peptide"
IYPYIGGS

SEQ ID NO: 1022 - protein, 13 aa, Artificial Sequence
  source: /note="Description of Artificial Sequence: Synthetic peptide"
AREDKTARNAMDY

SEQ ID NO: 1023 - protein, 447 aa, Artificial Sequence
  source: /note="Description of Artificial Sequence: Synthetic polypeptide"
QVQLVQSGAEVKKPGASVKVSCKASGYTFTDYNINWVRQAPGQGLEWMGYIYPYIGGSGYAQKFQGRVTMTRDTSTSTVYMELSSLRSEDTAVYYCAREDKTARNAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1024 - protein, 107 aa, Artificial Sequence
  source: /note="Description of Artificial Sequence: Synthetic polypeptide"
DIQMTQSPSSLSASVGDRVTITCRVSENIYSNLAWYQQKPGKAPKLLIYEATNLAEGVPSRFSGSGSGTDFTLTISSLQPEDFATYYCQHFWGTPYTFGQGTKLEIK

SEQ ID NO: 1025 - protein, 6 aa, Artificial Sequence
  source: /note="Description of Artificial Sequence: Synthetic peptide"
ENIYSN

SEQ ID NO: 1026 - protein, 3 aa, Artificial Sequence
  source: /note="Description of Artificial Sequence: Synthetic peptide"
EAT

SEQ ID NO: 1027 - protein, 9 aa, Artificial Sequence
  source: /note="Description of Artificial Sequence: Synthetic peptide"
QHFWGTPYT

SEQ ID NO: 1028 - protein, 214 aa, Artificial Sequence
  source: /note="Description of Artificial Sequence: Synthetic polypeptide"
DIQMTQSPSSLSASVGDRVTITCRVSENIYSNLAWYQQKPGKAPKLLIYEATNLAEGVPSRFSGSGSGTDFTLTISSLQPEDFATYYCQHFWGTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1029 - protein, 119 aa, Artificial Sequence
  source: /note="Description of Artificial Sequence: Synthetic polypeptide"
QVQLVQSGAEVKKPGASVKVSCKASGYAFTNYLIEWVRQAPGQGLEWIGVINPGSGGIYYAQKFQGRVTMTADTSTSTVYMELSSLRSEDTAVYYCARSETHDTWFAYWGQGTLVTVSS

SEQ ID NO: 1030 - protein, 8 aa, Artificial Sequence
  source: /note="Description of Artificial Sequence: Synthetic peptide"
GYAFTNYL

SEQ ID NO: 1031 - protein, 8 aa, Artificial Sequence
  source: /note="Description of Artificial Sequence: Synthetic peptide"
INPGSGGI

SEQ ID NO: 1032 - protein, 12 aa, Artificial Sequence
  source: /note="Description of Artificial Sequence: Synthetic peptide"
ARSETHDTWFAY

SEQ ID NO: 1033 - protein, 446 aa, Artificial Sequence
  source: /note="Description of Artificial Sequence: Synthetic polypeptide"
QVQLVQSGAEVKKPGASVKVSCKASGYAFTNYLIEWVRQAPGQGLEWIGVINPGSGGIYYAQKFQGRVTMTADTSTSTVYMELSSLRSEDTAVYYCARSETHDTWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1034 - protein, 107 aa, Artificial Sequence
  source: /note="Description of Artificial Sequence: Synthetic polypeptide"
DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIK

SEQ ID NO: 1035 - protein, 6 aa, Artificial Sequence
  source: /note="Description of Artificial Sequence: Synthetic peptide"
QSVRIA

SEQ ID NO: 1036 - protein, 3 aa, Artificial Sequence
  source: /note="Description of Artificial Sequence: Synthetic peptide"
LAS

SEQ ID NO: 1037 - protein, 9 aa, Artificial Sequence
  source: /note="Description of Artificial Sequence: Synthetic peptide"
LQHWNYPYT

SEQ ID NO: 1038 - protein, 214 aa, Artificial Sequence
  source: /note="Description of Artificial Sequence: Synthetic polypeptide"
DIQMTQSPSSLSASVGDRVTITCKASQSVRIAVAWFQQKPGKAPKALIYLASTRHTGVPSRFSGSGSGTDFTLTISSVQPEDFATYYCLQHWNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1039 - protein, 120 aa, Artificial Sequence
  source: /note="Description of Artificial Sequence: Synthetic polypeptide"
EVQLQQSGAELVRSGASVKMSCKVNDYTFTNYNMHWLRQTPGQGLEWIGYIYPGNGDTNYNQKFKGKATLTADTSSSTAYMQIISLTSEDPAVYFCARQGIHYYYIDVWGAGTTVTVSSG

SEQ ID NO: 1040 - protein, 10 aa, Artificial Sequence
  source: /note="Description of Artificial Sequence: Synthetic peptide"
DYTFTNYNMH

SEQ ID NO: 1041 - protein, 13 aa, Artificial Sequence
  source: /note="Description of Artificial Sequence: Synthetic peptide"
YIYPGNGDTNYNQ

SEQ ID NO: 1042 - protein, 10 aa, Artificial Sequence
  source: /note="Description of Artificial Sequence: Synthetic peptide"
QGIHYYYIDV

SEQ ID NO: 1043 - protein, 110 aa, Artificial Sequence
  source: /note="Description of Artificial Sequence: Synthetic polypeptide"
DIEMTQSPATLSVTPGDRVSLSCRASQSIRDYLHWYQQKSHESPRLLIKYVSQSISGIPSRFSGSGSGSEFTLSINSVEPEDVGVYYCQNGHSLPLTFGSGTKLEIKRTV

SEQ ID NO: 1044 - protein, 11 aa, Artificial Sequence
  source: /note="Description of Artificial Sequence: Synthetic peptide"
RASQSIRDYLH

SEQ ID NO: 1045 - protein, 7 aa, Artificial Sequence
  source: /note="Description of Artificial Sequence: Synthetic peptide"
YVSQSIS

SEQ ID NO: 1046 - protein, 9 aa, Artificial Sequence
  source: /note="Description of Artificial Sequence: Synthetic peptide"
QNGHSLPLT

SEQ ID NO: 1047 - protein, 118 aa, Artificial Sequence
  source: /note="Description of Artificial Sequence: Synthetic polypeptide"
QVQLQQSGAELAKPGASVKMSCKASGYTFTSDWMHWVKQRPGQGLEWIGYINPSTGYTEYNQKFKDKATLTADKSSSTAYMQLRSLTSEDSAVYYCARGSSGSWFAYWGQGTLVTVSA

SEQ ID NO: 1048 - protein, 5 aa, Artificial Sequence
  source: /note="Description of Artificial Sequence: Synthetic peptide"
SDWMH

SEQ ID NO: 1049 - protein, 17 aa, Artificial Sequence
  source: /note="Description of Artificial Sequence: Synthetic peptide"
YINPSTGYTEYNQKFKD

SEQ ID NO: 1050 - protein, 9 aa, Artificial Sequence
  source: /note="Description of Artificial Sequence: Synthetic peptide"
GSSGSWFAY

SEQ ID NO: 1051 - protein, 111 aa, Artificial Sequence
  source: /note="Description of Artificial Sequence: Synthetic polypeptide"
DIVLTQSPASLAVSLGQRATISCRASQSVSTSSYSYMHWYQQKPGQPPKLLIKYASNLESGVPARFSGSGSGTDFTLNIHPVEEEDTATYYCQHSWEIPYTFGGGTKLEIK

SEQ ID NO: 1052 - protein, 15 aa, Artificial Sequence
  source: /note="Description of Artificial Sequence: Synthetic peptide"
RASQSVSTSSYSYMH

SEQ ID NO: 1053 - protein, 7 aa, Artificial Sequence
  source: /note="Description of Artificial Sequence: Synthetic peptide"
YASNLES

SEQ ID NO: 1054 - protein, 9 aa, Artificial Sequence
  source: /note="Description of Artificial Sequence: Synthetic peptide"
QHSWEIPYT

SEQ ID NO: 1055 - protein, 118 aa, Artificial Sequence; identical to SEQ ID NO: 1047
  source: /note="Description of Artificial Sequence: Synthetic polypeptide"

SEQ ID NO: 1056 - protein, 5 aa, Artificial Sequence
  source: /note="Description of Artificial Sequence: Synthetic peptide"
SDWMH

SEQ ID NO: 1057 - protein, 17 aa, Artificial Sequence
  source: /note="Description of Artificial Sequence: Synthetic peptide"
YINPSTGYTEYNQKFKD

SEQ ID NO: 1058 - protein, 9 aa, Artificial Sequence
  source: /note="Description of Artificial Sequence: Synthetic peptide"
GSSGSWFAY

SEQ ID NO: 1059 - protein, 112 aa, Artificial Sequence
  source: /note="Description of Artificial Sequence: Synthetic polypeptide"
DVVMTQTPLTLSVTIGQPASISCKSSQSLLNSDGKTYLNWLLQRPGQSPKRLIYLVSKLDSGVPDRFTGSGSGTDFTLKISRVEAEDLGVYYCWQGTHFPRTFGGGTKLEIK

SEQ ID NO: 1060 - protein, 16 aa, Artificial Sequence
  source: /note="Description of Artificial Sequence: Synthetic peptide"
KSSQSLLNSDGKTYLN

SEQ ID NO: 1061 - protein, 7 aa, Artificial Sequence
  source: /note="Description of Artificial Sequence: Synthetic peptide"
LVSKLDS

SEQ ID NO: 1062 - protein, 9 aa, Artificial Sequence
  source: /note="Description of Artificial Sequence: Synthetic peptide"
WQGTHFPRT

SEQ ID NO: 1063 - protein, 114 aa, Artificial Sequence
  source: /note="Description of Artificial Sequence: Synthetic polypeptide"
EVQLQQSVAELVRPGTSVTISCKASGYTFTNYWLGWVKQRPGHGLEWIGDIFPGGDYPNYNEKFKGKATLTADTSSSTAYMQLSSLTSEDSSVYFCTRGYFDVWGAGTTVTVSS

SEQ ID NO: 1064 - protein, 6 aa, Artificial Sequence
  source: /note="Description of Artificial Sequence: Synthetic peptide"
TNYWLG

SEQ ID NO: 1065 - protein, 17 aa, Artificial Sequence
  source: /note="Description of Artificial Sequence: Synthetic peptide"
DIFPGGDYPNYNEKFKG

SEQ ID NO: 1066 - protein, 7 aa, Artificial Sequence
  source: /note="Description of Artificial Sequence: Synthetic peptide"
TRGYFDV

SEQ ID NO: 1067 - protein, 114 aa, Artificial Sequence
  source: /note="Description of Artificial Sequence: Synthetic polypeptide"
DIQMTQSPSSLSVSAGEKVTMSCKSSQSLLNSENQKNYLAWFQQKPGQPPKMLIYGASTRESGVPDRFTGSGSGTDFTLTISSVQAEDLAVYYCQNDHSYPFTFGSGTKLEIKR

SEQ ID NO: 1068 - protein, 17 aa, Artificial Sequence
  source: /note="Description of Artificial Sequence: Synthetic peptide"
KSSQSLLNSENQKNYLA

SEQ ID NO: 1069 - protein, 7 aa, Artificial Sequence
  source: /note="Description of Artificial Sequence: Synthetic peptide"
GASTRES

SEQ ID NO: 1070 - protein, 7 aa, Artificial Sequence
  source: /note="Description of Artificial Sequence: Synthetic peptide"
QNDHSYP

SEQ ID NO: 1071 - protein, 120 aa, Artificial Sequence
  source: /note="Description of Artificial Sequence: Synthetic polypeptide"
EVQLVLSGGGFVQPGGSLKLSCAASGFTFSSYAMSWVRQNPERRLVWVATITGGGRNTYYPDSVKGRFTISRDNAKNTLYLQMSSLRSEDTAMYYCTRQGYDGYTWFAYWGQGTLVTVSS

SEQ ID NO: 1072 - protein, 8 aa, Artificial Sequence
  source: /note="Description of Artificial Sequence: Synthetic peptide"
GFTFSSYA

SEQ ID NO: 1073 - protein, 8 aa, Artificial Sequence
  source: /note="Description of Artificial Sequence: Synthetic peptide"
ITGGGRNT

SEQ ID NO: 1074 - protein, 13 aa, Artificial Sequence
  source: /note="Description of Artificial Sequence: Synthetic peptide"
TRQGYDGYTWFAY

SEQ ID NO: 1075 - protein, 447 aa, Artificial Sequence
  source: /note="Description of Artificial Sequence: Synthetic polypeptide"
EVQLVLSGGGFVQPGGSLKLSCAASGFTFSSYAMSWVRQNPERRLVWVATITGGGRNTYYPDSVKGRFTISRDNAKNTLYLQMSSLRSEDTAMYYCTRQGYDGYTWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 1076 - protein, 112 aa, Artificial Sequence
  source: /note="Description of Artificial Sequence: Synthetic polypeptide"
DIVLTQSPTSLAVSLGQRATISCRASESVDNSGISFMNWFQQKPGQPPKLLIYAASNPGSGVPARFSGSGSGTDFSLNIHPMEEDDTAMYFCQQSKEVPWTFGGGTELEIKR

SEQ ID NO: 1077 - protein, 10 aa, Artificial Sequence
  source: /note="Description of Artificial Sequence: Synthetic peptide"
ESVDNSGISF

SEQ ID NO: 1078 - protein, 3 aa, Artificial Sequence
  source: /note="Description of Artificial Sequence: Synthetic peptide"
AAS

SEQ ID NO: 1079 - protein, 9 aa, Artificial Sequence
  source: /note="Description of Artificial Sequence: Synthetic peptide"
QQSKEVPWT

SEQ ID NO: 1080 - protein, 218 aa, Artificial Sequence
  source: /note="Description of Artificial Sequence: Synthetic polypeptide"
DIVLTQSPTSLAVSLGQRATISCRASESVDNSGISFMNWFQQKPGQPPKLLIYAASNPGSGVPARFSGSGSGTDFSLNIHPMEEDDTAMYFCQQSKEVPWTFGGGTELEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1081 - protein, 447 aa, Artificial Sequence
  source: /note="Description of Artificial Sequence: Synthetic polypeptide"
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1082 - protein, 218 aa, Artificial Sequence
  source: /note="Description of Artificial Sequence: Synthetic polypeptide"
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1083 - protein, 113 aa, Artificial Sequence [sequence omitted]

SEQ ID NO: 1084 - protein, 8 aa, Artificial Sequence
  source: /note="Description of Artificial Sequence: Synthetic peptide"
GITFSNSG

SEQ ID NO: 1085 - protein, 8 aa, Artificial Sequence
  source: /note="Description of Artificial Sequence: Synthetic peptide"
IWYDGSKR

SEQ ID NO: 1086 - protein, 6 aa, Artificial Sequence
  source: /note="Description of Artificial Sequence: Synthetic peptide"
ATNDDY

SEQ ID NO: 1087 - protein, 440 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1088 - protein, 108 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKR

SEQ ID NO: 1089 - protein, 6 aa, Artificial Sequence
  source: /note="Description of Artificial Sequence: Synthetic peptide"
QSVSSY

SEQ ID NO: 1090 - protein, 3 aa, Artificial Sequence
  source: /note="Description of Artificial Sequence: Synthetic peptide"
DAS

SEQ ID NO: 1091 - protein, 9 aa, Artificial Sequence
  source: /note="Description of Artificial Sequence: Synthetic peptide"
QQSSNWPRT

SEQ ID NO: 1092 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1093 - protein, 440 aa, Artificial Sequence; identical to SEQ ID NO: 1087
  source: /note="Description of Artificial Sequence: Synthetic polypeptide"

SEQ ID NO: 1094 - protein, 214 aa, Artificial Sequence; identical to SEQ ID NO: 1092
  source: /note="Description of Artificial Sequence: Synthetic polypeptide"

SEQ ID NO: 1095 - protein, 117 aa, Artificial Sequence [sequence omitted]

SEQ ID NO: 1096 - protein, 8 aa, Artificial Sequence
  source: /note="Description of Artificial Sequence: Synthetic peptide"
GFTFSNFG

SEQ ID NO: 1097 - protein, 8 aa, Artificial Sequence
  source: /note="Description of Artificial Sequence: Synthetic peptide"
ISGGGRDT

SEQ ID NO: 1098 - protein, 10 aa, Artificial Sequence
  source: /note="Description of Artificial Sequence: Synthetic peptide"
VKWGNIYFDY

SEQ ID NO: 1099 - protein, 107 aa, Artificial Sequence [sequence omitted]

SEQ ID NO: 1100 - protein, 6 aa, Artificial Sequence
  source: /note="Description of Artificial Sequence: Synthetic peptide"
LSINTF

SEQ ID NO: 1101 - protein, 3 aa, Artificial Sequence
  source: /note="Description of Artificial Sequence: Synthetic peptide"
AAS

SEQ ID NO: 1102 - protein, 9 aa, Artificial Sequence
  source: /note="Description of Artificial Sequence: Synthetic peptide"
QQSSNTPFT

SEQ ID NO: 1103 - protein, 444 aa, Artificial Sequence
  source: /note="Description of Artificial Sequence: Synthetic polypeptide"
EVQLLESGGVLVQPGGSLRLSCAASGFTFSNFGMTWVRQAPGKGLEWVSGISGGGRDTYFADSVKGRFTISRDNSKNTLYLQMNSLKGEDTAVYYCVKWGNIYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1104 - protein, 214 aa, Artificial Sequence
  source: /note="Description of Artificial Sequence: Synthetic polypeptide"
DIQMTQSPSSLSASVGDSITITCRASLSINTFLNWYQQKPGKAPNLLIYAASSLHGGVPSRFSGSGSGTDFTLTIRTLQPEDFATYYCQQSSNTPFTFGPGTVVDFRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1105 - protein, 8 aa, Artificial Sequence
  source: /note="Description of Artificial Sequence: Synthetic peptide"
GFTFSSYA

SEQ ID NO: 1106 - protein, 5 aa, Artificial Sequence
  source: /note="Description of Artificial Sequence: Synthetic peptide"
SYAMH

SEQ ID NO: 1107 - protein, 8 aa, Artificial Sequence
  source: /note="Description of Artificial Sequence: Synthetic peptide"
ISYAGEVK

SEQ ID NO: 1108 - protein, 17 aa, Artificial Sequence
  source: /note="Description of Artificial Sequence: Synthetic peptide"
VISYAGEVKYYADSVKG

SEQ ID NO: 1109 - protein, 14 aa, Artificial Sequence
  source: /note="Description of Artificial Sequence: Synthetic peptide"
ARDPLPLHYYGMDV

SEQ ID NO: 1110 - protein, 12 aa, Artificial Sequence
  source: /note="Description of Artificial Sequence: Synthetic peptide"
DPLPLHYYGMDV

SEQ ID NO: 1111 - protein, 8 aa, Artificial Sequence
  source: /note="Description of Artificial Sequence: Synthetic peptide"
SSNMGRRP

SEQ ID NO: 1112 - protein, 13 aa, Artificial Sequence
  source: /note="Description of Artificial Sequence: Synthetic peptide"
SGSSSNMGRRPVN

SEQ ID NO: 1113 - protein, 3 aa, Artificial Sequence
  source: /note="Description of Artificial Sequence: Synthetic peptide"
SQN

SEQ ID NO: 1114 - protein, 7 aa, Artificial Sequence
  source: /note="Description of Artificial Sequence: Synthetic peptide"
SQNQRPS

SEQ ID NO: 1115 - protein, 11 aa, Artificial Sequence
  source: /note="Description of Artificial Sequence: Synthetic peptide"
AVWDDIGRVLQ

SEQ ID NO: 1116 - protein, 11 aa, Artificial Sequence
  source: /note="Description of Artificial Sequence: Synthetic peptide"
AVWDDIGRVLQ

SEQ ID NO: 1117 - protein, 121 aa, Artificial Sequence
  source: /note="Description of Artificial Sequence: Synthetic polypeptide"
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 1118 - protein, 5 aa, Artificial Sequence
  source: /note="Description of Artificial Sequence: Synthetic peptide"
RYWMS

SEQ ID NO: 1119 - protein, 17 aa, Artificial Sequence
  source: /note="Description of Artificial Sequence: Synthetic peptide"
NIKQDGSEKYYVDSVKG

SEQ ID NO: 1120 - protein, 11 aa, Artificial Sequence
  source: /note="Description of Artificial Sequence: Synthetic peptide"
EGGWFGELAFD

SEQ ID NO: 1121 - protein, 108 aa, Artificial Sequence
  source: /note="Description of Artificial Sequence: Synthetic polypeptide"
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 1122 - protein, 12 aa, Artificial Sequence
  source: /note="Description of Artificial Sequence: Synthetic peptide"
RASQRVSSSYLA

SEQ ID NO: 1123 - protein, 7 aa, Artificial Sequence
  source: /note="Description of Artificial Sequence: Synthetic peptide"
DASSRAT

SEQ ID NO: 1124 - protein, 9 aa, Artificial Sequence
  source: /note="Description of Artificial Sequence: Synthetic peptide"
QQYGSLPWT

SEQ ID NO: 1125 - protein, 447 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1126 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLFTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1127 - protein, 118 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 1128 - protein, 10 aa, Artificial Sequence
  source: /note="Description of Artificial Sequence: Synthetic peptide"
GFTFSDSWIH

SEQ ID NO: 1129 - protein, 18 aa, Artificial Sequence
  source: /note="Description of Artificial Sequence: Synthetic peptide"
AWISPYGGSTYYADSVKG

SEQ ID NO: 1130 - protein, 9 aa, Artificial Sequence
  source: /note="Description of Artificial Sequence: Synthetic peptide"
RHWPGGFDY

SEQ ID NO: 1131 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 1132 - protein, 11 aa, Artificial Sequence
  source: /note="Description of Artificial Sequence: Synthetic peptide"
RASQDVSTAVA

SEQ ID NO: 1133 - protein, 7 aa, Artificial Sequence
  source: /note="Description of Artificial Sequence: Synthetic peptide"
SASFLYS

SEQ ID NO: 1134 - protein, 9 aa, Artificial Sequence
  source: /note="Description of Artificial Sequence: Synthetic peptide"
QQYLYHPAT

SEQ ID NO: 1135 - protein, 122 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTK

SEQ ID NO: 1136 - protein, 108 aa, Artificial Sequence; identical to SEQ ID NO: 1131
  source: /note="Description of Artificial Sequence: Synthetic polypeptide"

SEQ ID NO: 1137 - protein, 118 aa, Artificial Sequence [sequence omitted]

SEQ ID NO: 1138 - protein, 108 aa, Artificial Sequence; identical to SEQ ID NO: 1131
  source: /note="Description of Artificial Sequence: Synthetic polypeptide"

SEQ ID NO: 1139 - protein, 118 aa, Artificial Sequence
  source: /note="Description of Artificial Sequence: Synthetic polypeptide"
EVQLVESCGGLVQPGGSLRLSCAASGFTFSDSWIHWVRQAPGKGLEWVAWISPYGGSTYYADSVKGRFTISRDTSKNTAYLQMNSLRAEDTAVYYCARRHWPGGFDYWGQGTLVTVSA

SEQ ID NO: 1140 - protein, 118 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISRDTSKNTAYLQMNSLRAEDTAVYYCARRHWPGGFDYWGQGTLVTVSA

SEQ ID NO: 1141 - protein, 118 aa, Artificial Sequence
  source: /note="Description of Artificial Sequence: Synthetic polypeptide"
EVQLVESGGGLVQPGGSLRLSCAASGFTFSGSWIHWVRQAPGKGLEWVAWILPYGGSSYYADSVKGRFTISRDTSKNTAYLQMNSLRAEDTAVYYCARRHWPGGFDYWGQGTLVTVSA

SEQ ID NO: 1142 - protein, 108 aa, Artificial Sequence; identical to SEQ ID NO: 1131
  source: /note="Description of Artificial Sequence: Synthetic polypeptide"

SEQ ID NO: 1143 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYYNVPWTFGQGTKVEIKR

SEQ ID NO: 1144 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYYAPPWTFGQGTKVEIKR

SEQ ID NO: 1145 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYYTVPWTFGQGTKVEIKR

SEQ ID NO: 1146 - protein, 108 aa, Artificial Sequence
  source: /note="Description of Artificial Sequence: Synthetic polypeptide"
DIQMTQSPSSLSASVGDRVTITCRASQVINTFLAWYQQKPGKAPKLLIYSASTLASGVPSRFSGSGSGTDFTLTISSLQPEDFATYYCQQYYTVPRTFGQGTKVEIKR

SEQ ID NO: 1147 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQGYGVPRTFGQGTKVEIKR

SEQ ID NO: 1148 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLFTPPTFGQGTKVEIKR

SEQ ID NO: 1149 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYFITPTTFGQGTKVEIKR

SEQ ID NO: 1150 - protein, 107 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYYTPPTFGQGTKVEIKR

SEQ ID NO: 1151 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQFFYTPPTFGQGTKVEIKR

SEQ ID NO: 1152 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQSLFTPPTFGQGTKVEIKR

SEQ ID NO: 1153 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQSLYTPPTFGQGTKVEIKR

SEQ ID NO: 1154 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQSWYHPPTFGQGTKVEIKR

SEQ ID NO: 1155 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYFYIPPTFGQGTKVEIKR

SEQ ID NO: 1156 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYWYTPYTFGQGTKVEIKR

SEQ ID NO: 1157 - protein, 108 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQSYFIPPTFGQGTKVEIKR

SEQ ID NO: 1158 - protein, 450 aa, Artificial Sequence
  source: /note="Description of Artificial Sequence: Synthetic polypeptide"
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1159 - protein, 216 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1160 - protein, 118 aa, Artificial Sequence; identical to SEQ ID NO: 1127
  source: /note="Description of Artificial Sequence: Synthetic polypeptide"

SEQ ID NO: 1161 - protein, 106 aa, Artificial Sequence
  source: /note="Description of Artificial Sequence: Synthetic polypeptide"
DIQMTQSPSSLSASVGDRVTITCRASQDVSTAVAWYQQKPGKAPKWYSASFLYSGVPSRFSGSGSGTDFTLTISSLQPEDFATYYCQQYLYHPATFGQGTKVEIKR

SEQ ID NO: 1162 - protein, 448 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1163 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1164 - protein, 120 aa, Artificial Sequence
  source: /note="Description of Artificial Sequence: Synthetic polypeptide"
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEVSSPYGMDVWGQGTTVTVSS

SEQ ID NO: 1165 - protein, 8 aa, Artificial Sequence
  source: /note="Description of Artificial Sequence: Synthetic peptide"
GGTFSSYA

SEQ ID NO: 1166 - protein, 8 aa, Artificial Sequence
  source: /note="Description of Artificial Sequence: Synthetic peptide"
IIPIFGTA

SEQ ID NO: 1167 - protein, 13 aa, Artificial Sequence
  source: /note="Description of Artificial Sequence: Synthetic peptide"
AREEVSSPYGMDV

SEQ ID NO: 1168 - protein, 450 aa, Artificial Sequence
  source: /note="Description of Artificial Sequence: Synthetic polypeptide"
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEVSSPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1169 - protein, 111 aa, Artificial Sequence
  source: /note="Description of Artificial Sequence: Synthetic polypeptide"
QAVVTQEPSLTVSPGGTVTLTCGTSTGAVTSGHYPYWFQQKPGQAPKTLIYDTGNKHSWTPARFSGSLLGGKAALTLSGAQPEDEADYYCLLSYSGASWVFGGGTKLTVLG

SEQ ID NO: 1170 - protein, 9 aa, Artificial Sequence
  source: /note="Description of Artificial Sequence: Synthetic peptide"
TGAVTSGHY

SEQ ID NO: 1171 - protein, 3 aa, Artificial Sequence
  source: /note="Description of Artificial Sequence: Synthetic peptide"
DTG

SEQ ID NO: 1172 - protein, 10 aa, Artificial Sequence
  source: /note="Description of Artificial Sequence: Synthetic peptide"
LLSYSGASWV

SEQ ID NO: 1173 - protein, 216 aa, Artificial Sequence
  source: /note="Description of Artificial Sequence: Synthetic polypeptide"
QAVVTQEPSLTVSPGGTVTLTCGTSTGAVTSGHYPYWFQQKPGQAPKTLIYDTGNKHSWTPARFSGSLLGGKAALTLSGAQPEDEADYYCLLSYSGASWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1174 - protein, 121 aa, Artificial Sequence
  source: /note="Description of Artificial Sequence: Synthetic polypeptide"
QVQLVQSGAEVKKPGASVKVSCKVSGFSLSHFSMHWVRQVPGKGLEWLGGFDPEEGGTIPAQKFQGRLTMTEDTSTETAYMELSSLRSEDTAVYYCATGIWYSSGWPVDYWGPGTLVTVSS

SEQ ID NO: 1175 - protein, 8 aa, Artificial Sequence
  source: /note="Description of Artificial Sequence: Synthetic peptide"
GFSLSHFS

SEQ ID NO: 1176 - protein, 8 aa, Artificial Sequence
  source: /note="Description of Artificial Sequence: Synthetic peptide"
FDPEEGGT

SEQ ID NO: 1177 - protein, 14 aa, Artificial Sequence
  source: /note="Description of Artificial Sequence: Synthetic peptide"
ATGIWYSSGWPVDY

SEQ ID NO: 1178 - protein, 458 aa, Artificial Sequence
  source: /note="Description of Artificial Sequence: Synthetic polypeptide"
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGPWYYDSSGYSSYAYYMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1179 - protein, 113 aa, Artificial Sequence
  source: /note="Description of Artificial Sequence: Synthetic polypeptide"
DVVMTQSPLSLPVTPGGPASISCRSSQSLLDSSGYNYVDWYLQKPGQSPQLLISLGSDRASGVPDRFSGSGSGTDFTLKISRVEAEDVGIYYCMQALQTPITFGQGTRLEIKR

SEQ ID NO: 1180 - protein, 11 aa, Artificial Sequence
  source: /note="Description of Artificial Sequence: Synthetic peptide"
QSLLDSSGYNY

SEQ ID NO: 1181 - protein, 3 aa, Artificial Sequence
  source: /note="Description of Artificial Sequence: Synthetic peptide"
LGS

SEQ ID NO: 1182 - protein, 9 aa, Artificial Sequence
  source: /note="Description of Artificial Sequence: Synthetic peptide"
MQALQTPIT

SEQ ID NO: 1183 - protein, 219 aa, Artificial Sequence
  source: /note="Description of Artificial Sequence: Synthetic polypeptide"
DVVMTQSPLSLPVTPGGPASISCRSSQSLLDSSGYNYVDWYLQKPGQSPQLLISLGSDRASGVPDRFSGSGSGTDFTLKISRVEAEDVGIYYCMQALQTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1184 - protein, 125 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATVSRVRGVINYYYYMDVWGKGTTVTVSS

SEQ ID NO: 1185 - protein, 8 aa, Artificial Sequence
  source: /note="Description of Artificial Sequence: Synthetic peptide"
GYTLTELS

SEQ ID NO: 1186 - protein, 8 aa, Artificial Sequence
  source: /note="Description of Artificial Sequence: Synthetic peptide"
FDPEDGET

SEQ ID NO: 1187 - protein, 18 aa, Artificial Sequence
  source: /note="Description of Artificial Sequence: Synthetic peptide"
ATVSRVRGVINYYYYMDV

SEQ ID NO: 1188 - protein, 455 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATVSRVRGVINYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1189 - protein, 113 aa, Artificial Sequence
  source: /note="Description of Artificial Sequence: Synthetic polypeptide"
DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKR

SEQ ID NO: 1190 - protein, 11 aa, Artificial Sequence
  source: /note="Description of Artificial Sequence: Synthetic peptide"
QSLLYRNGNNY

SEQ ID NO: 1191 - protein, 3 aa, Artificial Sequence
  source: /note="Description of Artificial Sequence: Synthetic peptide"
LGS

SEQ ID NO: 1192 - protein, 9 aa, Artificial Sequence
  source: /note="Description of Artificial Sequence: Synthetic peptide"
MQALQTPPT

SEQ ID NO: 1193 - protein, 219 aa, Artificial Sequence
  source: /note="Description of Artificial Sequence: Synthetic polypeptide"
DVVMTQSPLSLPVTPGEPASISCRSSQSLLYRNGNNYLDWYLQKPGQSPQLLIYLGSNRASGVPDRFSGSGSGTDFTLKISRVEAEDVGVYYCMQALQTPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1194 - protein, 120 aa, Artificial Sequence
  source: /note="Description of Artificial Sequence: Synthetic polypeptide"
QVQLVQSGAEVRRPGSSVRVSCKPSGGTFGTYAFTWVRQAPGQGLEWMGGITPISATINRAQNLQDRLTITADESTTTVHMDLTSLRSEDTAVYYCARGFEYSDGLLDDWGQGTLVTVSS

SEQ ID NO: 1195 - protein, 8 aa, Artificial Sequence
  source: /note="Description of Artificial Sequence: Synthetic peptide"
GGTFGTYA

SEQ ID NO: 1196 - protein, 8 aa, Artificial Sequence
  source: /note="Description of Artificial Sequence: Synthetic peptide"
ITPISATI

SEQ ID NO: 1197 - protein, 13 aa, Artificial Sequence
  source: /note="Description of Artificial Sequence: Synthetic peptide"
ARGFEYSDGLLDD

SEQ ID NO: 1198 - protein, 450 aa, Artificial Sequence
  source: /note="Description of Artificial Sequence: Synthetic polypeptide"
QVQLVQSGAEVRRPGSSVRVSCKPSGGTFGTYAFTWVRQAPGQGLEWMGGITPISATINRAQNLQDRLTITADESTTTVHMDLTSLRSEDTAVYYCARGFEYSDGLLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1199 - protein, 114 aa, Artificial Sequence
  source: /note="Description of Artificial Sequence: Synthetic polypeptide"
DIVMTQTPLSLPVIPGEPASISCRSSQSLFYSDDGNTYLDWYLQKPGQSPQLLIYRLSHRASGVPDRFSGSGSGTDFTLKISRVEAEDVGVYYCMQHMEFPLTFGGGTKVEIKR

SEQ ID NO: 1200 - protein, 12 aa, Artificial Sequence
  source: /note="Description of Artificial Sequence: Synthetic peptide"
QSLFYSDDGNTY

SEQ ID NO: 1201 - protein, 3 aa, Artificial Sequence
  source: /note="Description of Artificial Sequence: Synthetic peptide"
RLS

SEQ ID NO: 1202 - protein, 9 aa, Artificial Sequence
  source: /note="Description of Artificial Sequence: Synthetic peptide"
MQHMEFPLT

SEQ ID NO: 1203 - protein, 220 aa, Artificial Sequence
  source: /note="Description of Artificial Sequence: Synthetic polypeptide"
DIVMTQTPLSLPVIPGEPASISCRSSQSLFYSDDGNTYLDWYLQKPGQSPQLLIYRLSHRASGVPDRFSGSGSGTDFTLKISRVEAEDVGVYYCMQHMEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1204 - protein, 117 aa, Artificial Sequence
  source: /note="Description of Artificial Sequence: Synthetic polypeptide"
QVQLQESGPGLVKPSGTLSLTCVVSSGSISSTNWWTWVRQPPGKGLEWIGEIYHSGSTSYNSSLKSRVTISEDKSKNQISLRLSSVTAADTAVYYCARVGPAAIYYWGQGTLVTVSS

SEQ ID NO: 1205 - protein, 9 aa, Artificial Sequence
  source: /note="Description of Artificial Sequence: Synthetic peptide"
SGSISSTNW

SEQ ID NO: 1206 - protein, 7 aa, Artificial Sequence
  source: /note="Description of Artificial Sequence: Synthetic peptide"
IYHSGST

SEQ ID NO: 1207 - protein, 10 aa, Artificial Sequence
  source: /note="Description of Artificial Sequence: Synthetic peptide"
ARVGPAAIYY

SEQ ID NO: 1208 - protein, 447 aa, Artificial Sequence
  source: /note="Description of Artificial Sequence: Synthetic polypeptide"
QVQLQESGPGLVKPSGTLSLTCVVSSGSISSTNWWTWVRQPPGKGLEWIGEIYHSGSTSYNSSLKSRVTISEDKSKNQISLRLSSVTAADTAVYYCARVGPAAIYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1209 - protein, 111 aa, Artificial Sequence
  source: /note="Description of Artificial Sequence: Synthetic polypeptide"
QAGLTQPPSVSKGLRQTATLTCTGNSNNVGYEGAAWLQQHQGHAPKLLLYRNNNRPSGISKRFSASRSGNTASLTITGLQPEDEADYYCSAWDSSLNAVVFGGGTQLTVLG

SEQ ID NO: 1210 - protein, 8 aa, Artificial Sequence
  source: /note="Description of Artificial Sequence: Synthetic peptide"
SNNVGYEG

SEQ ID NO: 1211 - protein, 3 aa, Artificial Sequence
  source: /note="Description of Artificial Sequence: Synthetic peptide"
RNN

SEQ ID NO: 1212 - protein, 11 aa, Artificial Sequence
  source: /note="Description of Artificial Sequence: Synthetic peptide"
SAWDSSLNAVV

SEQ ID NO: 1213 - protein, 216 aa, Artificial Sequence
  source: /note="Description of Artificial Sequence: Synthetic polypeptide"
QAGLTQPPSVSKGLRQTATLTCTGNSNNVGYEGAAWLQQHQGHAPKLLLYRNNNRPSGISKRFSASRSGNTASLTITGLQPEDEADYYCSAWDSSLNAVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1214 - protein, 128 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAKPGIAVAGQNYYYYYMDVWGKGTTVTVSS

SEQ ID NO: 1215 - protein, 8 aa, Artificial Sequence
  source: /note="Description of Artificial Sequence: Synthetic peptide"
GYTLTELS

SEQ ID NO: 1216 - protein, 8 aa, Artificial Sequence
  source: /note="Description of Artificial Sequence: Synthetic peptide"
FDPEDGET

SEQ ID NO: 1217 - protein, 21 aa, Artificial Sequence
  source: /note="Description of Artificial Sequence: Synthetic peptide"
ATAKPGIAVAGQNYYYYYMDV

SEQ ID NO: 1218 - protein, 458 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAKPGIAVAGQNYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1219 - protein, 113 aa, Artificial Sequence; identical to SEQ ID NO: 1189
  source: /note="Description of Artificial Sequence: Synthetic polypeptide"

SEQ ID NO: 1220 - protein, 11 aa, Artificial Sequence
  source: /note="Description of Artificial Sequence: Synthetic peptide"
QSLLYRNGNNY

SEQ ID NO: 1221 - protein, 3 aa, Artificial Sequence
  source: /note="Description of Artificial Sequence: Synthetic peptide"
LGS

SEQ ID NO: 1222 - protein, 9 aa, Artificial Sequence
  source: /note="Description of Artificial Sequence: Synthetic peptide"
MQALQTPPT

SEQ ID NO: 1223 - protein, 219 aa, Artificial Sequence; identical to SEQ ID NO: 1193
  source: /note="Description of Artificial Sequence: Synthetic polypeptide"

SEQ ID NO: 1224 - protein, 124 aa, Artificial Sequence
  source: /note="Description of Artificial Sequence: Synthetic polypeptide"
EVQLVESGGGLVQPGRSLRLSCAASGFTFSSYAMHWVRQAPGKGLEWVAVISYDGSNKYYADSVKGRFTISRDNSKNTLYLQMNSLRAEDTAVYYCASSPIGYSYGYWGGMDVWGQGTTVTVSS

SEQ ID NO: 1225 - protein, 8 aa, Artificial Sequence
  source: /note="Description of Artificial Sequence: Synthetic peptide"
GFTFSSYA

SEQ ID NO: 1226 - protein, 8 aa, Artificial Sequence
  source: /note="Description of Artificial Sequence: Synthetic peptide"
ISYDGSNK

SEQ ID NO: 1227 - protein, 17 aa, Artificial Sequence
  source: /note="Description of Artificial Sequence: Synthetic peptide"
ASSPIGYSYGYWGGMDV

SEQ ID NO: 1228 - protein, 454 aa, Artificial Sequence
  source: /note="Description of Artificial Sequence: Synthetic polypeptide"
EVQLVESGGGLVQPGRSLRLSCAASGFTFSSYAMHWVRQAPGKGLEWVAVISYDGSNKYYADSVKGRFTISRDNSKNTLYLQMNSLRAEDTAVYYCASSPIGYSYGYWGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1229 - protein, 116 aa, Artificial Sequence
  source: /note="Description of Artificial Sequence: Synthetic polypeptide"
QAVLTQPASLSASPGASASLTCTLRSGIDVRTNKIFWYQVKPGSPPQHLLTFQSDSDKQQGSGVPSRFSGSKDASANAGILIISGLQSEDEADYYCLIWHTSGWVFGGGTQLTVLG

SEQ ID NO: 1230 - protein, 9 aa, Artificial Sequence
  source: /note="Description of Artificial Sequence: Synthetic peptide"
SGIDVRTNK

SEQ ID NO: 1231 - protein, 7 aa, Artificial Sequence
  source: /note="Description of Artificial Sequence: Synthetic peptide"
FQSDSDK

SEQ ID NO: 1232 - protein, 9 aa, Artificial Sequence
  source: /note="Description of Artificial Sequence: Synthetic peptide"
LIWHTSGWV

SEQ ID NO: 1233 - protein, 221 aa, Artificial Sequence
  source: /note="Description of Artificial Sequence: Synthetic polypeptide"
QAVLTQPASLSASPGASASLTCTLRSGIDVRTNKIFWYQVKPGSPPQHLLTFQSDSDKQQGSGVPSRFSGSKDASANAGILIISGLQSEDEADYYCLIWHTSGWVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1234 - protein, 124 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGPAAAGVGYYYYMDVWGKGTTVTVSS

SEQ ID NO: 1235 - protein, 8 aa, Artificial Sequence
  source: /note="Description of Artificial Sequence: Synthetic peptide"
GYTLTELS

SEQ ID NO: 1236 - protein, 8 aa, Artificial Sequence
  source: /note="Description of Artificial Sequence: Synthetic peptide"
FDPEDGET

SEQ ID NO: 1237 - protein, 17 aa, Artificial Sequence
  source: /note="Description of Artificial Sequence: Synthetic peptide"
ATGPAAAGVGYYYYMDV

SEQ ID NO: 1238 - protein, 454 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGPAAAGVGYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1239 - protein, 113 aa, Artificial Sequence
  source: /note="Description of Artificial Sequence: Synthetic polypeptide"
DVVMTQSPLSLPVTPGEPASISCRSSQSLLYRNGYNYLDWYLQKPGQSPQLLIYLGSNRASGVPDRFSGSGSGTDFTLKISRVEAEDVGVYYCMQALQTPPTFGQGTKVEIKR

SEQ ID NO: 1240 - protein, 11 aa, Artificial Sequence
  source: /note="Description of Artificial Sequence: Synthetic peptide"
QSLLYRNGYNY

SEQ ID NO: 1241 - protein, 3 aa, Artificial Sequence
  source: /note="Description of Artificial Sequence: Synthetic peptide"
LGS

SEQ ID NO: 1242 - protein, 9 aa, Artificial Sequence
  source: /note="Description of Artificial Sequence: Synthetic peptide"
MQALQTPPT

SEQ ID NO: 1243 - protein, 219 aa, Artificial Sequence
  source: /note="Description of Artificial Sequence: Synthetic polypeptide"
DVVMTQSPLSLPVTPGEPASISCRSSQSLLYRNGYNYLDWYLQKPGQSPQLLIYLGSNRASGVPDRFSGSGSGTDFTLKISRVEAEDVGVYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1244 - protein, 127 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDVMVYCSSTSCYFYGMDVWGQGTTVTVSS

SEQ ID NO: 1245 - protein, 8 aa, Artificial Sequence
  source: /note="Description of Artificial Sequence: Synthetic peptide"
GFTFSSYA

SEQ ID NO: 1246 - protein, 8 aa, Artificial Sequence
  source: /note="Description of Artificial Sequence: Synthetic peptide"
ISYDGSNK

SEQ ID NO: 1247 - protein, 20 aa, Artificial Sequence
  source: /note="Description of Artificial Sequence: Synthetic peptide"
ARDVMVYCSSTSCYFYGMDV

SEQ ID NO: 1248 - protein, 457 aa, Artificial Sequence
  source: /note="Description of Artificial Sequence: Synthetic polypeptide"
EVQLVETGGGLIQPGRSLRLSCAASGFTFSSYAMHWVRQAPGKGLEWVAVISYDGSNKYYADSVKGRFTISRDNSKNTLYLQMNSLRAEDTAVYYCARDVMVYCSSTSCYFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1249 - protein, 108 aa, Artificial Sequence
  source: /note="Description of Artificial Sequence: Synthetic polypeptide"
DIQMTQSPSSLSASVGDRVTVTCQASQDIRDYLNWYQKKPGKAPKLLIYDASNLEAGVPSRFSGSGSGTDFTFTISGLQPEDVATYYCQQFENLPITFGQGTRLEIKR

SEQ ID NO: 1250 - protein, 6 aa, Artificial Sequence
  source: /note="Description of Artificial Sequence: Synthetic peptide"
QDIRDY

SEQ ID NO: 1251 - protein, 3 aa, Artificial Sequence
  source: /note="Description of Artificial Sequence: Synthetic peptide"
DAS

SEQ ID NO: 1252 - protein, 9 aa, Artificial Sequence
  source: /note="Description of Artificial Sequence: Synthetic peptide"
QQFENLPIT

SEQ ID NO: 1253 - protein, 214 aa, Artificial Sequence
  source: /note="Description of Artificial Sequence: Synthetic polypeptide"
DIQMTQSPSSLSASVGDRVTVTCQASQDIRDYLNWYQKKPGKAPKLLIYDASNLEAGVPSRFSGSGSGTDFTFTISGLQPEDVATYYCQQFENLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1254 - protein, 125 aa, Artificial Sequence
  source: /note="Description of Artificial Sequence: Synthetic polypeptide"
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSSGFNYYYYYMDVWGKGTTVTVSS

SEQ ID NO: 1255 - protein, 8 aa, Artificial Sequence
  source: /note="Description of Artificial Sequence: Synthetic peptide"
GYTLTELS

SEQ ID NO: 1256 - protein, 8 aa, Artificial Sequence
  source: /note="Description of Artificial Sequence: Synthetic peptide"
FDPEDGET

SEQ ID NO: 1257 - protein, 18 aa, Artificial Sequence
  source: /note="Description of Artificial Sequence: Synthetic peptide"
ATGGYSSGFNYYYYYMDV

SEQ ID NO: 1258 - protein, 455 aa, Artificial Sequence
  source: /note="Description of Artificial Sequence: Synthetic polypeptide"
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSSGFNYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1259 - protein, 113 aa, Artificial Sequence; identical to SEQ ID NO: 1189
  source: /note="Description of Artificial Sequence: Synthetic polypeptide"

SEQ ID NO: 1260 - protein, 11 aa, Artificial Sequence
  source: /note="Description of Artificial Sequence: Synthetic peptide"
QSLLYRNGNNY

SEQ ID NO: 1261 - protein, 3 aa, Artificial Sequence
  source: /note="Description of Artificial Sequence: Synthetic peptide"
LGS

SEQ ID NO: 1262 - protein, 9 aa, Artificial Sequence
  source: /note="Description of Artificial Sequence: Synthetic peptide"
MQALQTPPT

SEQ ID NO: 1263 - protein, 219 aa, Artificial Sequence; identical to SEQ ID NO: 1193
  source: /note="Description of Artificial Sequence: Synthetic polypeptide"

SEQ ID NO: 1264 - protein, 121 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVTTYYYYGMDVWGQGTTVTVSS

SEQ ID NO: 1265 - protein, 8 aa, Artificial Sequence
  source: /note="Description of Artificial Sequence: Synthetic peptide"
GYTLTELS

SEQ ID NO: 1266 - protein, 8 aa, Artificial Sequence
  source: /note="Description of Artificial Sequence: Synthetic peptide"
FDPEDGET

SEQ ID NO: 1267 - protein, 14 aa, Artificial Sequence
  source: /note="Description of Artificial Sequence: Synthetic peptide"
ATGVTTYYYYGMDV

SEQ ID NO: 1268 - protein, 451 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVTTYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1269 - protein, 113 aa, Artificial Sequence
  source: /note="Description of Artificial Sequence: Synthetic polypeptide"
DVVMTQSPLSLPVTPGEPASISCRSSQSLLYSNGNNFLDWYLQKPGQSPRLLISLGSNRASGVPDRFSGSGSGTDFTLKISRVEAEDVGIYYCMQALQTPPTFGQGTKVEIKR

SEQ ID NO: 1270 - protein, 11 aa, Artificial Sequence
  source: /note="Description of Artificial Sequence: Synthetic peptide"
QSLLYSNGNNF

SEQ ID NO: 1271 - protein, 3 aa, Artificial Sequence
  source: /note="Description of Artificial Sequence: Synthetic peptide"
LGS

SEQ ID NO: 1272 - protein, 9 aa, Artificial Sequence
  source: /note="Description of Artificial Sequence: Synthetic peptide"
MQALQTPPT

SEQ ID NO: 1273 - protein, 219 aa, Artificial Sequence
  source: /note="Description of Artificial Sequence: Synthetic polypeptide"
DVVMTQSPLSLPVTPGEPASISCRSSQSLLYSNGNNFLDWYLQKPGQSPRLLISLGSNRASGVPDRFSGSGSGTDFTLKISRVEAEDVGIYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1274 - protein, 121 aa, Artificial Sequence
  source: /note="Description of Artificial Sequence: Synthetic polypeptide"
QITLKESGGGVVQPGGSLRLSCAASGFTFSSYGMHWVRQAPGKGLEWVAFIRYDGSNKYYADSVKGRFTISRDNSKNTLYLQMNSLRAEDTAVYYCARDLFDFWWDGMDVWGQGTTVTVSS

SEQ ID NO: 1275 - protein, 8 aa, Artificial Sequence
  source: /note="Description of Artificial Sequence: Synthetic peptide"
GFTFSSYG

SEQ ID NO: 1276 - protein, 8 aa, Artificial Sequence
  source: /note="Description of Artificial Sequence: Synthetic peptide"
IRYDGSNK

SEQ ID NO: 1277 - protein, 14 aa, Artificial Sequence
  source: /note="Description of Artificial Sequence: Synthetic peptide"
ARDLFDFWWDGMDV

SEQ ID NO: 1278 - protein, 451 aa, Artificial Sequence
  source: /note="Description of Artificial Sequence: Synthetic polypeptide"
QITLKESGGGVVQPGGSLRLSCAASGFTFSSYGMHWVRQAPGKGLEWVAFIRYDGSNKYYADSVKGRFTISRDNSKNTLYLQMNSLRAEDTAVYYCARDLFDFWWDGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1279 - protein, 110 aa, Artificial Sequence
  source: /note="Description of Artificial Sequence: Synthetic polypeptide"
EIVLTQSPGTLSLSPGEKATLSCRVSQSVSSMYLAWYQQKPGQAPRLLIYGASYRATGIPDRFSGSGSGTDFNLTISRLEPEDFAVYYCQQYVSSPMYTFGLGTKLEIKR

SEQ ID NO: 1280 - protein, 7 aa, Artificial Sequence
  source: /note="Description of Artificial Sequence: Synthetic peptide"
QSVSSMY

SEQ ID NO: 1281 - protein, 3 aa, Artificial Sequence
  source: /note="Description of Artificial Sequence: Synthetic peptide"
GAS

SEQ ID NO: 1282 - protein, 10 aa, Artificial Sequence
  source: /note="Description of Artificial Sequence: Synthetic peptide"
QQYVSSPMYT

SEQ ID NO: 1283 - protein, 216 aa, Artificial Sequence
  source: /note="Description of Artificial Sequence: Synthetic polypeptide"
EIVLTQSPGTLSLSPGEKATLSCRVSQSVSSMYLAWYQQKPGQAPRLLIYGASYRATGIPDRFSGSGSGTDFNLTISRLEPEDFAVYYCQQYVSSPMYTFGLGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1284 - protein, 122 aa, Artificial Sequence
  source: /note="Description of Artificial Sequence: Synthetic polypeptide"
QVQLVQSGAEVKKPGSSVKVSCKASGGTFNNYGISWVRQAPGKGLEWMGQIIPLFGTTKYAQKFQGRVTIAADEPTSTAYMELGSLRSEDTAIYYCARDRMAADGMAVFDYWGQGTLVTVSS

SEQ ID NO: 1285 - protein, 8 aa, Artificial Sequence
  source: /note="Description of Artificial Sequence: Synthetic peptide"
GGTFNNYG

SEQ ID NO: 1286 - protein, 8 aa, Artificial Sequence
  source: /note="Description of Artificial Sequence: Synthetic peptide"
IIPLFGTT

SEQ ID NO: 1287 - protein, 15 aa, Artificial Sequence
  source: /note="Description of Artificial Sequence: Synthetic peptide"
ARDRMAADGMAVFDY

SEQ ID NO: 1288 - protein, 452 aa, Artificial Sequence
  source: /note="Description of Artificial Sequence: Synthetic polypeptide"
QVQLVQSGAEVKKPGSSVKVSCKASGGTFNNYGISWVRQAPGKGLEWMGQIIPLFGTTKYAQKFQGRVTIAADEPTSTAYMELGSLRSEDTAIYYCARDRMAADGMAVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1289 - protein, 111 aa, Artificial Sequence
  source: /note="Description of Artificial Sequence: Synthetic polypeptide"
QSVLTQPPSVSGTPGQKVIISCSGSSSNIGRHFVFWYQQLPGTAPKLLIYKNDERPSGVPDRFSGSKSGTSASLAVSGLRSEDEADYYCSSWDAALNGVVFGGGTKLTVLG

SEQ ID NO: 1290 - protein, 8 aa, Artificial Sequence
  source: /note="Description of Artificial Sequence: Synthetic peptide"
SSNIGRHF

SEQ ID NO: 1291 - protein, 3 aa, Artificial Sequence
  source: /note="Description of Artificial Sequence: Synthetic peptide"
KND

SEQ ID NO: 1292 - protein, 11 aa, Artificial Sequence
  source: /note="Description of Artificial Sequence: Synthetic peptide"
SSWDAALNGVV

SEQ ID NO: 1293 - protein, 216 aa, Artificial Sequence
  source: /note="Description of Artificial Sequence: Synthetic polypeptide"
QSVLTQPPSVSGTPGQKVIISCSGSSSNIGRHFVFWYQQLPGTAPKLLIYKNDERPSGVPDRFSGSKSGTSASLAVSGLRSEDEADYYCSSWDAALNGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1294 - protein, 126 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVPMVRGARRYYYYMDVWGKGTTVTVSS

SEQ ID NO: 1295 - protein, 8 aa, Artificial Sequence
  source: /note="Description of Artificial Sequence: Synthetic peptide"
GYTLTELS

SEQ ID NO: 1296 - protein, 8 aa, Artificial Sequence
  source: /note="Description of Artificial Sequence: Synthetic peptide"
FDPEDGET

SEQ ID NO: 1297 - protein, 19 aa, Artificial Sequence
  source: /note="Description of Artificial Sequence: Synthetic peptide"
ATEVPMVRGARRYYYYMDV

SEQ ID NO: 1298 - protein, 456 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVPMVRGARRYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1299 - protein, 113 aa, Artificial Sequence
  source: /note="Description of Artificial Sequence: Synthetic polypeptide"
DVVMTQSPLFLAVTPGEPASISCRSSQTLLYINENNYLDWYVQKPGQSPQLLIYLGSTRASGVPDRFSGGGSGTDFTLTISRVEAEDVGLYYCMQGLQTPPTFGQGTRLEIKR

SEQ ID NO: 1300 - protein, 11 aa, Artificial Sequence
  source: /note="Description of Artificial Sequence: Synthetic peptide"
QTLLYINENNY

SEQ ID NO: 1301 - protein, 3 aa, Artificial Sequence
  source: /note="Description of Artificial Sequence: Synthetic peptide"
LGS

SEQ ID NO: 1302 - protein, 9 aa, Artificial Sequence
  source: /note="Description of Artificial Sequence: Synthetic peptide"
MQGLQTPPT

SEQ ID NO: 1303 - protein, 219 aa, Artificial Sequence
  source: /note="Description of Artificial Sequence: Synthetic polypeptide"
DVVMTQSPLFLAVTPGEPASISCRSSQTLLYINENNYLDWYVQKPGQSPQLLIYLGSTRASGVPDRFSGGGSGTDFTLTISRVEAEDVGLYYCMQGLQTPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1304 - protein, 123 aa, Artificial Sequence
  source: /note="Description of Artificial Sequence: Synthetic polypeptide"
QVQLQESGPGLVKSSETLSLTCSVSGGSISNSNYYWGWIRQPPGKGLEWIGGIYYSGSTYYNPSLESRVTISEDTSKNQISLKLSSVTAADTAVYYCARGAWELSLGDWFDPWGPGTLVTVSS

SEQ ID NO: 1305 - protein, 10 aa, Artificial Sequence
  source: /note="Description of Artificial Sequence: Synthetic peptide"
GGSISNSNYY

SEQ ID NO: 1306 - protein, 7 aa, Artificial Sequence
  source: /note="Description of Artificial Sequence: Synthetic peptide"
IYYSGST

SEQ ID NO: 1307 - protein, 15 aa, Artificial Sequence
  source: /note="Description of Artificial Sequence: Synthetic peptide"
ARGAWELSLGDWFDP

SEQ ID NO: 1308 - protein, 453 aa, Artificial Sequence
  source: /note="Description of Artificial Sequence: Synthetic polypeptide"
QVQLQESGPGLVKSSETLSLTCSVSGGSISNSNYYWGWIRQPPGKGLEWIGGIYYSGSTYYNPSLESRVTISEDTSKNQISLKLSSVTAADTAVYYCARGAWELSLGDWFDPWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1309 - protein, 113 aa, Artificial Sequence
  source: /note="Description of Artificial Sequence: Synthetic polypeptide"
QSVLTQPPSVSGAPGQRVTISCTGSSSNIGAGYDIQWYQQLPGTAPKLLIYGNNNRPSGVPDRFSGSRSGTSASLAITGLQAEDEADYYCQSYDSSLSVYVVFGGGTQLTVLG

SEQ ID NO: 1310 - protein, 9 aa, Artificial Sequence
  source: /note="Description of Artificial Sequence: Synthetic peptide"
SSNIGAGYD

SEQ ID NO: 1311 - protein, 3 aa, Artificial Sequence
  source: /note="Description of Artificial Sequence: Synthetic peptide"
GNN

SEQ ID NO: 1312 - protein, 12 aa, Artificial Sequence
  source: /note="Description of Artificial Sequence: Synthetic peptide"
QSYDSSLSVYVV

SEQ ID NO: 1313 - protein, 218 aa, Artificial Sequence
  source: /note="Description of Artificial Sequence: Synthetic polypeptide"
QSVLTQPPSVSGAPGQRVTISCTGSSSNIGAGYDIQWYQQLPGTAPKLLIYGNNNRPSGVPDRFSGSRSGTSASLAITGLQAEDEADYYCQSYDSSLSVYVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1314 - protein, 122 aa, Artificial Sequence
  source: /note="Description of Artificial Sequence: Synthetic polypeptide"
EVQLVESGGGVVKPGGSLRLSCAASGFTFGTSSMNWVRQAPGKGLEWVAVISFDGTEIHYADSVKGRFTISRDNSKSTVFLQMNSLRPDDTALYYCAKGSGNIYFYSGMDVWGQGTTVTVSS

SEQ ID NO: 1315 - protein, 8 aa, Artificial Sequence
  source: /note="Description of Artificial Sequence: Synthetic peptide"
GFTFGTSS

SEQ ID NO: 1316 - protein, 8 aa, Artificial Sequence
  source: /note="Description of Artificial Sequence: Synthetic peptide"
ISFDGTEI

SEQ ID NO: 1317 - protein, 15 aa, Artificial Sequence
  source: /note="Description of Artificial Sequence: Synthetic peptide"
AKGSGNIYFYSGMDV

SEQ ID NO: 1318 - protein, 452 aa, Artificial Sequence
  source: /note="Description of Artificial Sequence: Synthetic polypeptide"
EVQLVESGGGVVKPGGSLRLSCAASGFTFGTSSMNWVRQAPGKGLEWVAVISFDGTEIHYADSVKGRFTISRDNSKSTVFLQMNSLRPDDTALYYCAKGSGNIYFYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1319 - protein, 108 aa, Artificial Sequence
  source: /note="Description of Artificial Sequence: Synthetic polypeptide"
DIQMTQSPSTLSASVGDRVTITCRAGQSISGWLAWFQQKPGKAPNLLIYETSTLESGVPSRFSGSGSGTEYTLTISSLQPDDFATYYCQQYYSYPLTFGQGTKVEIKR

SEQ ID NO: 1320 - protein, 6 aa, Artificial Sequence
  source: /note="Description of Artificial Sequence: Synthetic peptide"
QSISGW

SEQ ID NO: 1321 - protein, 3 aa, Artificial Sequence
  source: /note="Description of Artificial Sequence: Synthetic peptide"
ETS

SEQ ID NO: 1322 - protein, 9 aa, Artificial Sequence
  source: /note="Description of Artificial Sequence: Synthetic peptide"
QQYYSYPLT

SEQ ID NO: 1323 - protein, 214 aa, Artificial Sequence
  source: /note="Description of Artificial Sequence: Synthetic polypeptide"
DIQMTQSPSTLSASVGDRVTITCRAGQSISGWLAWFQQKPGKAPNLLIYETSTLESGVPSRFSGSGSGTEYTLTISSLQPDDFATYYCQQYYSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1324 - protein, 126 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYYMDVWGKGTTVTVSS

SEQ ID NO: 1325 - protein, 8 aa, Artificial Sequence
  source: /note="Description of Artificial Sequence: Synthetic peptide"
GYTLTELS

SEQ ID NO: 1326 - protein, 8 aa, Artificial Sequence
  source: /note="Description of Artificial Sequence: Synthetic peptide"
FDPEDGET

SEQ ID NO: 1327 - protein, 19 aa, Artificial Sequence
  source: /note="Description of Artificial Sequence: Synthetic peptide"
ATGVPAAIGVYYYYYYMDV

SEQ ID NO: 1328 - protein, 456 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGVPAAIGVYYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1329 - protein, 113 aa, Artificial Sequence
  source: /note="Description of Artificial Sequence: Synthetic polypeptide"
DVVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQSPVTFGGGTKVEIKR

SEQ ID NO: 1330 - protein, 11 aa, Artificial Sequence
  source: /note="Description of Artificial Sequence: Synthetic peptide"
QSLLYSNGYNY

SEQ ID NO: 1331 - protein, 3 aa, Artificial Sequence
  source: /note="Description of Artificial Sequence: Synthetic peptide"
LGS

SEQ ID NO: 1332 - protein, 9 aa, Artificial Sequence
  source: /note="Description of Artificial Sequence: Synthetic peptide"
MQALQSPVT

SEQ ID NO: 1333 - protein, 219 aa, Artificial Sequence
  source: /note="Description of Artificial Sequence: Synthetic polypeptide"
DVVMTQSPLSLPVTPGEPASISCRSSQSLLYSNGYNYLDWYLQKPGQSPQLLISLGSNRASGVPDRFSGSGSGTDFTLKISRVEAEDVGVYYCMQALQSPVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1334 - protein, 127 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSRDGPAARGGYYYYMDVWGQGTTVTVSS

SEQ ID NO: 1335 - protein, 8 aa, Artificial Sequence
  source: /note="Description of Artificial Sequence: Synthetic peptide"
GYTLTELS

SEQ ID NO: 1336 - protein, 8 aa, Artificial Sequence
  source: /note="Description of Artificial Sequence: Synthetic peptide"
FDPEDGET

SEQ ID NO: 1337 - protein, 20 aa, Artificial Sequence
  source: /note="Description of Artificial Sequence: Synthetic peptide"
ATDSRDGPAARGGYYYYMDV

SEQ ID NO: 1338 - protein, 457 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDSRDGPAARGGYYYYMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1339 - protein, 113 aa, Artificial Sequence
  source: /note="Description of Artificial Sequence: Synthetic polypeptide"
DVVMTQSPLSLPVTLGQPASISCRSSQSLLYINGYNYLDWYLQKPGQSPQLLIYLGSNRASGVPDRFSGSGSGTDFTLKISRVEAEDVGVYYCMQALQTPPTFGQGTKVEIKR

SEQ ID NO: 1340 - protein, 11 aa, Artificial Sequence
  source: /note="Description of Artificial Sequence: Synthetic peptide"
QSLLYINGYNY

SEQ ID NO: 1341 - protein, 3 aa, Artificial Sequence
  source: /note="Description of Artificial Sequence: Synthetic peptide"
LGS

SEQ ID NO: 1342 - protein, 9 aa, Artificial Sequence
  source: /note="Description of Artificial Sequence: Synthetic peptide"
MQALQTPPT

SEQ ID NO: 1343 - protein, 219 aa, Artificial Sequence
  source: /note="Description of Artificial Sequence: Synthetic polypeptide"
DVVMTQSPLSLPVTLGQPASISCRSSQSLLYINGYNYLDWYLQKPGQSPQLLIYLGSNRASGVPDRFSGSGSGTDFTLKISRVEAEDVGVYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1344 - protein, 127 aa, Artificial Sequence
  source: /note="Description of Artificial Sequence: Synthetic polypeptide"
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDAYYYDSSGYYNPDAFDIWGQGTMVTVSS

SEQ ID NO: 1345 - protein, 8 aa, Artificial Sequence
  source: /note="Description of Artificial Sequence: Synthetic peptide"
GGTFSSYA

SEQ ID NO: 1346 - protein, 8 aa, Artificial Sequence
  source: /note="Description of Artificial Sequence: Synthetic peptide"
IIPIFGTA

SEQ ID NO: 1347 - protein, 20 aa, Artificial Sequence
  source: /note="Description of Artificial Sequence: Synthetic peptide"
ARDAYYYDSSGYYNPDAFDI

SEQ ID NO: 1348 - protein, 457 aa, Artificial Sequence
  source: /note="Description of Artificial Sequence: Synthetic polypeptide"
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDAYYYDSSGYYNPDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1349 - protein, 113 aa, Artificial Sequence
  source: /note="Description of Artificial Sequence: Synthetic polypeptide"
DVVMTQSPLSLPVTPGEPASISCRSSQSLLHSNGYNYLDWYLQKPGQSPQLLIYLGSSRASGVPDRFSGSVSGTDFTLKISRVEAEDVGVYYCMQGLQTPRTFGRGTKLEIKR

SEQ ID NO: 1350 - protein, 11 aa, Artificial Sequence
  source: /note="Description of Artificial Sequence: Synthetic peptide"
QSLLHSNGYNY

SEQ ID NO: 1351 - protein, 3 aa, Artificial Sequence
  source: /note="Description of Artificial Sequence: Synthetic peptide"
LGS

SEQ ID NO: 1352 - protein, 9 aa, Artificial Sequence
  source: /note="Description of Artificial Sequence: Synthetic peptide"
MQGLQTPRT

SEQ ID NO: 1353 - protein, 219 aa, Artificial Sequence
  source: /note="Description of Artificial Sequence: Synthetic polypeptide"
DVVMTQSPLSLPVTPGEPASISCRSSQSLLHSNGYNYLDWYLQKPGQSPQLLIYLGSSRASGVPDRFSGSVSGTDFTLKISRVEAEDVGVYYCMQGLQTPRTFGRGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1354 - protein, 129 aa, Artificial Sequence
  source: /note="Description of Artificial Sequence: Synthetic polypeptide"
QVQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSS

SEQ ID NO: 1355 - protein, 8 aa, Artificial Sequence
  source: /note="Description of Artificial Sequence: Synthetic peptide"
GGTFSSSA

SEQ ID NO: 1356 - protein, 8 aa, Artificial Sequence
  source: /note="Description of Artificial Sequence: Synthetic peptide"
IIPIYGIT

SEQ ID NO: 1357 - protein, 22 aa, Artificial Sequence
  source: /note="Description of Artificial Sequence: Synthetic peptide"
ARDDTARRVRGVPYYYYYAMDV

SEQ ID NO: 1358 - protein, 459 aa, Artificial Sequence
  source: /note="Description of Artificial Sequence: Synthetic polypeptide"
QVQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1359 - protein, 108 aa, Artificial Sequence
  source: /note="Description of Artificial Sequence: Synthetic polypeptide"
ETTLTQSPAFMSATPGDEVNISCKASQDIDDDVSWYQQKPGGAPIFLIQEASTLVPGIPPRFSGSGFGTDFTLTIKNMESEDAAYYFCLQHDNLPLTFGGGTKVDIKR

SEQ ID NO: 1360 - protein, 6 aa, Artificial Sequence
  source: /note="Description of Artificial Sequence: Synthetic peptide"
QDIDDD

SEQ ID NO: 1361 - protein, 3 aa, Artificial Sequence
  source: /note="Description of Artificial Sequence: Synthetic peptide"
EAS

SEQ ID NO: 1362 - protein, 9 aa, Artificial Sequence
  source: /note="Description of Artificial Sequence: Synthetic peptide"
LQHDNLPLT

SEQ ID NO: 1363 - protein, 214 aa, Artificial Sequence
  source: /note="Description of Artificial Sequence: Synthetic polypeptide"
ETTLTQSPAFMSATPGDEVNISCKASQDIDDDVSWYQQKPGGAPIFLIQEASTLVPGIPPRFSGSGFGTDFTLTIKNMESEDAAYYFCLQHDNLPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1364 - protein, 126 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEDPGPVAGPYYYYGMDVWGQGTTVTVSS

SEQ ID NO: 1365 - protein, 8 aa, Artificial Sequence
  source: /note="Description of Artificial Sequence: Synthetic peptide"
GYTLTELS

SEQ ID NO: 1366 - protein, 8 aa, Artificial Sequence
  source: /note="Description of Artificial Sequence: Synthetic peptide"
FDPEDGET

SEQ ID NO: 1367 - protein, 19 aa, Artificial Sequence
  source: /note="Description of Artificial Sequence: Synthetic peptide"
ATEDPGPVAGPYYYYGMDV

SEQ ID NO: 1368 - protein, 456 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEDPGPVAGPYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1369 - protein, 113 aa, Artificial Sequence
  source: /note="Description of Artificial Sequence: Synthetic polypeptide"
DVVMTQSPLVLPVTPGEPASISCRSSQSLLYINGYHYLDWYVQRPGQSPQLLIFLGSTRASGVPDRFSGSGSGTDFTLEISKVEAEDVGIYFCMQALQTPPTFGGGTKVEIKR

SEQ ID NO: 1370 - protein, 11 aa, Artificial Sequence
  source: /note="Description of Artificial Sequence: Synthetic peptide"
QSLLYINGYHY

SEQ ID NO: 1371 - protein, 3 aa, Artificial Sequence
  source: /note="Description of Artificial Sequence: Synthetic peptide"
LGS

SEQ ID NO: 1372 - protein, 9 aa, Artificial Sequence
  source: /note="Description of Artificial Sequence: Synthetic peptide"
MQALQTPPT

SEQ ID NO: 1373 - protein, 219 aa, Artificial Sequence
  source: /note="Description of Artificial Sequence: Synthetic polypeptide"
DVVMTQSPLVLPVTPGEPASISCRSSQSLLYINGYHYLDWYVQRPGQSPQLLIFLGSTRASGVPDRFSGSGSGTDFTLEISKVEAEDVGIYFCMQALQTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1374 - protein, 129 aa, Artificial Sequence; identical to SEQ ID NO: 1354
  source: /note="Description of Artificial Sequence: Synthetic polypeptide"

SEQ ID NO: 1375 - protein, 8 aa, Artificial Sequence
  source: /note="Description of Artificial Sequence: Synthetic peptide"
GGTFSSSA

SEQ ID NO: 1376 - protein, 8 aa, Artificial Sequence
  source: /note="Description of Artificial Sequence: Synthetic peptide"
IIPIYGIT

SEQ ID NO: 1377 - protein, 22 aa, Artificial Sequence
  source: /note="Description of Artificial Sequence: Synthetic peptide"
ARDDTARRVRGVPYYYYYAMDV

SEQ ID NO: 1378 - protein, 459 aa, Artificial Sequence; identical to SEQ ID NO: 1358
  source: /note="Description of Artificial Sequence: Synthetic polypeptide"

SEQ ID NO: 1379 - protein, 114 aa, Artificial Sequence
  source: /note="Description of Artificial Sequence: Synthetic polypeptide"
DIVMTQTPLSLPVTPGEPASISCRPSQSLLDSDDGNTYLDWYLQKPGQSPQLLIHTLSYRASGVPDRFSGSGSGTDFTLKISRVEAEDVGVYYCMQRLQFPLTFGGGTKVEIKR

SEQ ID NO: 1380 - protein, 12 aa, Artificial Sequence
  source: /note="Description of Artificial Sequence: Synthetic peptide"
QSLLDSDDGNTY

SEQ ID NO: 1381 - protein, 3 aa, Artificial Sequence
  source: /note="Description of Artificial Sequence: Synthetic peptide"
TLS

SEQ ID NO: 1382 - protein, 9 aa, Artificial Sequence
  source: /note="Description of Artificial Sequence: Synthetic peptide"
MQRLQFPLT

SEQ ID NO: 1383 - protein, 220 aa, Artificial Sequence
  source: /note="Description of Artificial Sequence: Synthetic polypeptide"
DIVMTQTPLSLPVTPGEPASISCRPSQSLLDSDDGNTYLDWYLQKPGQSPQLLIHTLSYRASGVPDRFSGSGSGTDFTLKISRVEAEDVGVYYCMQRLQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1384 - protein, 126 aa, Artificial Sequence; identical to SEQ ID NO: 1324
  source: /note="Description of Artificial Sequence: Synthetic polypeptide"

SEQ ID NO: 1385 - protein, 8 aa, Artificial Sequence
  source: /note="Description of Artificial Sequence: Synthetic peptide"
GYTLTELS

SEQ ID NO: 1386 - protein, 8 aa, Artificial Sequence
  source: /note="Description of Artificial Sequence: Synthetic peptide"
FDPEDGET

SEQ ID NO: 1387 - protein, 19 aa, Artificial Sequence
  source: /note="Description of Artificial Sequence: Synthetic peptide"
ATGVPAAIGVYYYYYYMDV

SEQ ID NO: 1388 - protein, 456 aa, Artificial Sequence; identical to SEQ ID NO: 1328
  source: /note="Description of Artificial Sequence: Synthetic polypeptide"

SEQ ID NO: 1389 - protein, 113 aa, Artificial Sequence
  source: /note="Description of Artificial Sequence: Synthetic polypeptide"
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVDIKR

SEQ ID NO: 1390 - protein, 11 aa, Artificial Sequence
  source: /note="Description of Artificial Sequence: Synthetic peptide"
QSLLYRNGYNY

SEQ ID NO: 1391 - protein, 3 aa, Artificial Sequence
  source: /note="Description of Artificial Sequence: Synthetic peptide"
WGS

SEQ ID NO: 1392 - protein, 9 aa, Artificial Sequence
  source: /note="Description of Artificial Sequence: Synthetic peptide"
MQAVQNPPT

SEQ ID NO: 1393 - protein, 219 aa, Artificial Sequence
  source: /note="Description of Artificial Sequence: Synthetic polypeptide"
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1394 - protein, 129 aa, Artificial Sequence; identical to SEQ ID NO: 1354
  source: /note="Description of Artificial Sequence: Synthetic polypeptide"

SEQ ID NO: 1395 - protein, 8 aa, Artificial Sequence
  source: /note="Description of Artificial Sequence: Synthetic peptide"
GGTFSSSA

SEQ ID NO: 1396 - protein, 8 aa, Artificial Sequence
  source: /note="Description of Artificial Sequence: Synthetic peptide"
IIPIYGIT

SEQ ID NO: 1397 - protein, 22 aa, Artificial Sequence
  source: /note="Description of Artificial Sequence: Synthetic peptide"
ARDDTARRVRGVPYYYYYAMDV

SEQ ID NO: 1398 - protein, 459 aa, Artificial Sequence; identical to SEQ ID NO: 1358
  source: /note="Description of Artificial Sequence: Synthetic polypeptide"

SEQ ID NO: 1399 - protein, 109 aa, Artificial Sequence
  source: /note="Description of Artificial Sequence: Synthetic polypeptide"
DVVMTQSPAFLSVTPGERVTLSCKASQTMNNYLAWYQQKPGQAPRLLIYDASTRATDTPPRFSGSGSGTEFTLTISSVQSEDFALYYCQQYGDWLPITFGQGTRLEIKR

SEQ ID NO: 1400 - protein, 6 aa, Artificial Sequence
  source: /note="Description of Artificial Sequence: Synthetic peptide"
QTMNNY

SEQ ID NO: 1401 - protein, 3 aa, Artificial Sequence
  source: /note="Description of Artificial Sequence: Synthetic peptide"
DAS

SEQ ID NO: 1402 - protein, 10 aa, Artificial Sequence
  source: /note="Description of Artificial Sequence: Synthetic peptide"
QQYGDWLPIT

SEQ ID NO: 1403 - protein, 215 aa, Artificial Sequence
  source: /note="Description of Artificial Sequence: Synthetic polypeptide"
DVVMTQSPAFLSVTPGERVTLSCKASQTMNNYLAWYQQKPGQAPRLLIYDASTRATDTPPRFSGSGSGTEFTLTISSVQSEDFALYYCQQYGDWLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1404 - protein, 124 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAFPEATISYYYYMDVWGKGTTVTVSS

SEQ ID NO: 1405 - protein, 8 aa, Artificial Sequence
  source: /note="Description of Artificial Sequence: Synthetic peptide"
GYTLTELS

SEQ ID NO: 1406 - protein, 8 aa, Artificial Sequence
  source: /note="Description of Artificial Sequence: Synthetic peptide"
FDPEDGET

SEQ ID NO: 1407 - protein, 17 aa, Artificial Sequence
  source: /note="Description of Artificial Sequence: Synthetic peptide"
ATAFPEATISYYYYMDV

SEQ ID NO: 1408 - protein, 454 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAFPEATISYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1409 - protein, 113 aa, Artificial Sequence
  source: /note="Description of Artificial Sequence: Synthetic polypeptide"
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVEIKR

SEQ ID NO: 1410 - protein, 11 aa, Artificial Sequence
  source: /note="Description of Artificial Sequence: Synthetic peptide"
QSLLYRNGYNY

SEQ ID NO: 1411 - protein, 3 aa, Artificial Sequence
  source: /note="Description of Artificial Sequence: Synthetic peptide"
WGS

SEQ ID NO: 1412 - protein, 9 aa, Artificial Sequence
  source: /note="Description of Artificial Sequence: Synthetic peptide"
MQAVQNPPT

SEQ ID NO: 1413 - protein, 219 aa, Artificial Sequence
  source: /note="Description of Artificial Sequence: Synthetic polypeptide"
DVVMTQSPLSLPVTPGEPASISCRSSQSLLYRNGYNYLDWYLQKPGQSPQLLIYWGSYRASGVPDRFSGSGSGTDFTLKISRVEAEDVGVYYCMQAVQNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1414 - protein, 129 aa, Artificial Sequence
  source: /note="Description of Artificial Sequence: Synthetic polypeptide"
QMQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSS

SEQ ID NO: 1415 - protein, 8 aa, Artificial Sequence
  source: /note="Description of Artificial Sequence: Synthetic peptide"
GGTFSSSA

SEQ ID NO: 1416 - protein, 8 aa, Artificial Sequence
  source: /note="Description of Artificial Sequence: Synthetic peptide"
IIPIYGIT

SEQ ID NO: 1417 - protein, 22 aa, Artificial Sequence
  source: /note="Description of Artificial Sequence: Synthetic peptide"
ARDDTARRVRGVPYYYYYAMDV

SEQ ID NO: 1418 - protein, 459 aa, Artificial Sequence
  source: /note="Description of Artificial Sequence: Synthetic polypeptide"
QMQLVQSGAEVKKPGSSVKVSCKASGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1419 - protein, 114 aa, Artificial Sequence
  source: /note="Description of Artificial Sequence: Synthetic polypeptide"
DIVMTQTPLSLPVTPGEPASMSCRSSRSLLDSDDGNTHLDWYLQKPGQSPQLLIQSLSYRASGVPDRFSGSGSGTDFTLEISRVEAEDVGIYYCMQRKEFPLTFGGGTKVEIKR

SEQ ID NO: 1420 - protein, 12 aa, Artificial Sequence
  source: /note="Description of Artificial Sequence: Synthetic peptide"
RSLLDSDDGNTH

SEQ ID NO: 1421 - protein, 3 aa, Artificial Sequence
  source: /note="Description of Artificial Sequence: Synthetic peptide"
SLS

SEQ ID NO: 1422 - protein, 9 aa, Artificial Sequence
  source: /note="Description of Artificial Sequence: Synthetic peptide"
MQRKEFPLT

SEQ ID NO: 1423 - protein, 220 aa, Artificial Sequence
  source: /note="Description of Artificial Sequence: Synthetic polypeptide"
DIVMTQTPLSLPVTPGEPASMSCRSSRSLLDSDDGNTHLDWYLQKPGQSPQLLIQSLSYRASGVPDRFSGSGSGTDFTLEISRVEAEDVGIYYCMQRKEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1424 - protein, 128 aa, Artificial Sequence
  source: /note="Description of Artificial Sequence: Synthetic polypeptide"
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGPWYYDSSGYSSYAYYMDVWGQGTTVTVSS

SEQ ID NO: 1425 - protein, 8 aa, Artificial Sequence
  source: /note="Description of Artificial Sequence: Synthetic peptide"
GGTFSSYA

SEQ ID NO: 1426 - protein, 8 aa, Artificial Sequence
  source: /note="Description of Artificial Sequence: Synthetic peptide"
IIPIFGTA

SEQ ID NO: 1427 - protein, 21 aa, Artificial Sequence
  source: /note="Description of Artificial Sequence: Synthetic peptide"
ARGPWYYDSSGYSSYAYYMDV

SEQ ID NO: 1428 - protein, 458 aa, Artificial Sequence; identical to SEQ ID NO: 1178
  source: /note="Description of Artificial Sequence: Synthetic polypeptide"

SEQ ID NO: 1429 - protein, 114 aa, Artificial Sequence
  source: /note="Description of Artificial Sequence: Synthetic polypeptide"
DVVMTQSPLSLPVTPGEPASISCRSSQSLLHSDGYNYLDWYLQKPGQSPQLLIYLGSNRASGVPDRFSGSGSGTDFTLKISRVEAEDVGVYYCMQALHTPGVTFGGGTKVEIKR

SEQ ID NO: 1430 - protein, 11 aa, Artificial Sequence
  source: /note="Description of Artificial Sequence: Synthetic peptide"
QSLLHSDGYNY

SEQ ID NO: 1431 - protein, 3 aa, Artificial Sequence
  source: /note="Description of Artificial Sequence: Synthetic peptide"
LGS

SEQ ID NO: 1432 - protein, 10 aa, Artificial Sequence
  source: /note="Description of Artificial Sequence: Synthetic peptide"
MQALHTPGVT

SEQ ID NO: 1433 - protein, 220 aa, Artificial Sequence
  source: /note="Description of Artificial Sequence: Synthetic polypeptide"
DVVMTQSPLSLPVTPGEPASISCRSSQSLLHSDGYNYLDWYLQKPGQSPQLLIYLGSNRASGVPDRFSGSGSGTDFTLKISRVEAEDVGVYYCMQALHTPGVTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1434 - protein, 123 aa, Artificial Sequence
  source: /note="Description of Artificial Sequence: Synthetic polypeptide"
QLQLQESGPGLVKPSETLSLTCTVTGGSISSSSYYWAWIRQPPGKGLEWIGGIYYSGSTYYNVSLESRVTISQDTSKNQFSLKLTSVTAADTAVYYCARGAWELRLGDWFDPWGQGTLVTVSS

SEQ ID NO: 1435 - protein, 10 aa, Artificial Sequence
  source: /note="Description of Artificial Sequence: Synthetic peptide"
GGSISSSSYY

SEQ ID NO: 1436 - protein, 7 aa, Artificial Sequence
  source: /note="Description of Artificial Sequence: Synthetic peptide"
IYYSGST

SEQ ID NO: 1437 - protein, 15 aa, Artificial Sequence
  source: /note="Description of Artificial Sequence: Synthetic peptide"
ARGAWELRLGDWFDP

SEQ ID NO: 1438 - protein, 453 aa, Artificial Sequence
  source: /note="Description of Artificial Sequence: Synthetic polypeptide"
QLQLQESGPGLVKPSETLSLTCTVTGGSISSSSYYWAWIRQPPGKGLEWIGGIYYSGSTYYNVSLESRVTISQDTSKNQFSLKLTSVTAADTAVYYCARGAWELRLGDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1439 - protein, 118 aa, Artificial Sequence
  source: /note="Description of Artificial Sequence: Synthetic polypeptide"
QSVLTQPPSVSGAPGQRVTISCTGSSSNIGAGYDIQWYQQLPGTAPKLLIYGYSNRPSGVPDRFSGSKSGTSASLAITGLQAEDEADYYCQSYDSSLSVYVVFGGGTQLTVLGQPKAA

SEQ ID NO: 1440 - protein, 9 aa, Artificial Sequence
  source: /note="Description of Artificial Sequence: Synthetic peptide"
SSNIGAGYD

SEQ ID NO: 1441 - protein, 3 aa, Artificial Sequence
  source: /note="Description of Artificial Sequence: Synthetic peptide"
GYS

SEQ ID NO: 1442 - protein, 12 aa, Artificial Sequence
  source: /note="Description of Artificial Sequence: Synthetic peptide"
QSYDSSLSVYVV

SEQ ID NO: 1443 - protein, 218 aa, Artificial Sequence
  source: /note="Description of Artificial Sequence: Synthetic polypeptide"
QSVLTQPPSVSGAPGQRVTISCTGSSSNIGAGYDIQWYQQLPGTAPKLLIYGYSNRPSGVPDRFSGSKSGTSASLAITGLQAEDEADYYCQSYDSSLSVYVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1444 - protein, 122 aa, Artificial Sequence
  source: /note="Description of Artificial Sequence: Synthetic polypeptide"
QVQLQESGGGVVQPGGSLRLSCAASRFTFEDYAMHWVRQPPGKGLEWVSGISWKSGGINYADSVKGRFTISRDNAQNSLYLQMNSLRAEDTALYYCVKDPTLVATDRAFNIWGQGTMVTVSS

SEQ ID NO: 1445 - protein, 8 aa, Artificial Sequence
  source: /note="Description of Artificial Sequence: Synthetic peptide"
RFTFEDYA

SEQ ID NO: 1446 - protein, 8 aa, Artificial Sequence
  source: /note="Description of Artificial Sequence: Synthetic peptide"
ISWKSGGI

SEQ ID NO: 1447 - protein, 15 aa, Artificial Sequence
  source: /note="Description of Artificial Sequence: Synthetic peptide"
VKDPTLVATDRAFNI

SEQ ID NO: 1448 - protein, 452 aa, Artificial Sequence
  source: /note="Description of Artificial Sequence: Synthetic polypeptide"
QVQLQESGGGVVQPGGSLRLSCAASRFTFEDYAMHWVRQPPGKGLEWVSGISWKSGGINYADSVKGRFTISRDNAQNSLYLQMNSLRAEDTALYYCVKDPTLVATDRAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1449 - protein, 117 aa, Artificial Sequence
  source: /note="Description of Artificial Sequence: Synthetic polypeptide"
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQYLQTPDTFGQGTKLEIKRAAPS

SEQ ID NO: 1450 - protein, 11 aa, Artificial Sequence
  source: /note="Description of Artificial Sequence: Synthetic peptide"
QSLLHSNGYNY

SEQ ID NO: 1451 - protein, 3 aa, Artificial Sequence
  source: /note="Description of Artificial Sequence: Synthetic peptide"
LGS

SEQ ID NO: 1452 - protein, 9 aa, Artificial Sequence
  source: /note="Description of Artificial Sequence: Synthetic peptide"
MQYLQTPDT

SEQ ID NO: 1453 - protein, 219 aa, Artificial Sequence
  source: /note="Description of Artificial Sequence: Synthetic polypeptide"
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQYLQTPDTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1454 - protein, 129 aa, Artificial Sequence; identical to SEQ ID NO: 1354
  source: /note="Description of Artificial Sequence: Synthetic polypeptide"

SEQ ID NO: 1455 - protein, 8 aa, Artificial Sequence
  source: /note="Description of Artificial Sequence: Synthetic peptide"
GGTFSSSA

SEQ ID NO: 1456 - protein, 8 aa, Artificial Sequence
  source: /note="Description of Artificial Sequence: Synthetic peptide"
IIPIYGIT

SEQ ID NO: 1457 - protein, 22 aa, Artificial Sequence
  source: /note="Description of Artificial Sequence: Synthetic peptide"
ARDDTARRVRGVPYYYYYAMDV

SEQ ID NO: 1458 - protein, 459 aa, Artificial Sequence; identical to SEQ ID NO: 1358
  source: /note="Description of Artificial Sequence: Synthetic polypeptide"

SEQ ID NO: 1459 - protein, 114 aa, Artificial Sequence
  source: /note="Description of Artificial Sequence: Synthetic polypeptide"
EIVLTQSPDFQSVTPKEKVTITCRASQNIDSSLHWYQQKPGQSPKLLINYASQSFSGVPSRFSGSGSGTDFTLTIDSLEPEDAATYFCHQSSSLPLTFGGGTKVEIRRTVAAPS

SEQ ID NO: 1460 - protein, 6 aa, Artificial Sequence
  source: /note="Description of Artificial Sequence: Synthetic peptide"
QNIDSS

SEQ ID NO: 1461 - protein, 3 aa, Artificial Sequence
  source: /note="Description of Artificial Sequence: Synthetic peptide"
YAS

SEQ ID NO: 1462 - protein, 9 aa, Artificial Sequence
  source: /note="Description of Artificial Sequence: Synthetic peptide"
HQSSSLPLT

SEQ ID NO: 1463 - protein, 218 aa, Artificial Sequence; identical to SEQ ID NO: 1443
  source: /note="Description of Artificial Sequence: Synthetic polypeptide"

SEQ ID NO: 1464 - protein, 129 aa, Artificial Sequence
  source: /note="Description of Artificial Sequence: Synthetic polypeptide"
EVQLVQSGAEVKKPGSSVKVSCKTSGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSS

SEQ ID NO: 1465 - protein, 8 aa, Artificial Sequence
  source: /note="Description of Artificial Sequence: Synthetic peptide"
GGTFSSSA

SEQ ID NO: 1466 - protein, 8 aa, Artificial Sequence
  source: /note="Description of Artificial Sequence: Synthetic peptide"
IIPIYGIT

SEQ ID NO: 1467 - protein, 22 aa, Artificial Sequence
  source: /note="Description of Artificial Sequence: Synthetic peptide"
ARDDTARRVRGVPYYYYYAMDV

SEQ ID NO: 1468 - protein, 459 aa, Artificial Sequence
  source: /note="Description of Artificial Sequence: Synthetic polypeptide"
EVQLVQSGAEVKKPGSSVKVSCKTSGGTFSSSAISWVRQAPGQGFEWMGGIIPIYGITDYAQKFQGRVTITTDESTSTAYMELSSLTSEDTAVYYCARDDTARRVRGVPYYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1469 - protein, 114 aa, Artificial Sequence
  source: /note="Description of Artificial Sequence: Synthetic polypeptide"
EIVLTQSPGTLSLSPGERATLSCRASQSVSSYLAWYQQKPGQAPRLLIYDASNRATGIPARFSGSGSGTDFTLTISSLQSEDFAVYYCQQYDDWPQTFGQGTRLEIKRTVAAPS

SEQ ID NO: 1470 - protein, 6 aa, Artificial Sequence
  source: /note="Description of Artificial Sequence: Synthetic peptide"
QSVSSY

SEQ ID NO: 1471 - protein, 3 aa, Artificial Sequence
  source: /note="Description of Artificial Sequence: Synthetic peptide"
DAS

SEQ ID NO: 1472 - protein, 9 aa, Artificial Sequence
  source: /note="Description of Artificial Sequence: Synthetic peptide"
QQYDDWPQT

SEQ ID NO: 1473 - protein, 214 aa, Artificial Sequence
  source: /note="Description of Artificial Sequence: Synthetic polypeptide"
EIVLTQSPGTLSLSPGERATLSCRASQSVSSYLAWYQQKPGQAPRLLIYDASNRATGIPARFSGSGSGTDFTLTISSLQSEDFAVYYCQQYDDWPQTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1474 - protein, 129 aa, Artificial Sequence; identical to SEQ ID NO: 1414
  source: /note="Description of Artificial Sequence: Synthetic polypeptide"

SEQ ID NO: 1475 - protein, 8 aa, Artificial Sequence
  source: /note="Description of Artificial Sequence: Synthetic peptide"
GGTFSSSA

SEQ ID NO: 1476 - protein, 8 aa, Artificial Sequence
  source: /note="Description of Artificial Sequence: Synthetic peptide"
IIPIYGIT

SEQ ID NO: 1477 - protein, 22 aa, Artificial Sequence
  source: /note="Description of Artificial Sequence: Synthetic peptide"
ARDDTARRVRGVPYYYYYAMDV

SEQ ID NO: 1478 - protein, 459 aa, Artificial Sequence; identical to SEQ ID NO: 1418
  source: /note="Description of Artificial Sequence: Synthetic polypeptide"

SEQ ID NO: 1479 - protein, 114 aa, Artificial Sequence
  source: /note="Description of Artificial Sequence: Synthetic polypeptide"
EIVMTQSPATLSLSTGERATLFCRTSQNVYGEVAWYQQKPGQAPRLLIYDTFERAAGIPAKFSGSGSGTDFTLTISRVEPEDFAVYYCQQRRDWPITFGQGTRLEIKRTVAAPS

SEQ ID NO: 1480 - protein, 6 aa, Artificial Sequence
  source: /note="Description of Artificial Sequence: Synthetic peptide"
QNVYGE

SEQ ID NO: 1481 - protein, 3 aa, Artificial Sequence
  source: /note="Description of Artificial Sequence: Synthetic peptide"
DTF

SEQ ID NO: 1482 - protein, 9 aa, Artificial Sequence
  source: /note="Description of Artificial Sequence: Synthetic peptide"
QQRRDWPIT

SEQ ID NO: 1483 - protein, 214 aa, Artificial Sequence
  source: /note="Description of Artificial Sequence: Synthetic polypeptide"
EIVMTQSPATLSLSTGERATLFCRTSQNVYGEVAWYQQKPGQAPRLLIYDTFERAAGIPAKFSGSGSGTDFTLTISRVEPEDFAVYYCQQRRDWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1484 - protein, 129 aa, Artificial Sequence; identical to SEQ ID NO: 1354
  source: /note="Description of Artificial Sequence: Synthetic polypeptide"

SEQ ID NO: 1485 - protein, 8 aa, Artificial Sequence
  source: /note="Description of Artificial Sequence: Synthetic peptide"
GGTFSSSA

SEQ ID NO: 1486 - protein, 8 aa, Artificial Sequence
  source: /note="Description of Artificial Sequence: Synthetic peptide"
IIPIYGIT

SEQ ID NO: 1487 - protein, 22 aa, Artificial Sequence
  source: /note="Description of Artificial Sequence: Synthetic peptide"
ARDDTARRVRGVPYYYYYAMDV

SEQ ID NO: 1488 - protein, 459 aa, Artificial Sequence; identical to SEQ ID NO: 1358
  source: /note="Description of Artificial Sequence: Synthetic polypeptide"

SEQ ID NO: 1489 - protein, 114 aa, Artificial Sequence
  source: /note="Description of Artificial Sequence: Synthetic polypeptide"
DIQMTQSPSSLSASVGDRVTITCQASRDISDSLSWYQQKPGKAPKLLIFDASNLKTGVSSRFSGSGSGTDFTFTISSLQPEDIATYYCHQYDNLPLTFGGGTKVEIKRTVAAPS

SEQ ID NO: 1490 - protein, 6 aa, Artificial Sequence
  source: /note="Description of Artificial Sequence: Synthetic peptide"
RDISDS

SEQ ID NO: 1491 - protein, 3 aa, Artificial Sequence
  source: /note="Description of Artificial Sequence: Synthetic peptide"
DAS

SEQ ID NO: 1492 - protein, 9 aa, Artificial Sequence
  source: /note="Description of Artificial Sequence: Synthetic peptide"
HQYDNLPLT

SEQ ID NO: 1493 - protein, 214 aa, Artificial Sequence
  source: /note="Description of Artificial Sequence: Synthetic polypeptide"
DIQMTQSPSSLSASVGDRVTITCQASRDISDSLSWYQQKPGKAPKLLIFDASNLKTGVSSRFSGSGSGTDFTFTISSLQPEDIATYYCHQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1494 - protein, 129 aa, Artificial Sequence; identical to SEQ ID NO: 1414
  source: /note="Description of Artificial Sequence: Synthetic polypeptide"

SEQ ID NO: 1495 - protein, 8 aa, Artificial Sequence
  source: /note="Description of Artificial Sequence: Synthetic peptide"
GGTFSSSA

SEQ ID NO: 1496 - protein, 8 aa, Artificial Sequence
  source: /note="Description of Artificial Sequence: Synthetic peptide"
IIPIYGIT

SEQ ID NO: 1497 - protein, 22 aa, Artificial Sequence
  source: /note="Description of Artificial Sequence: Synthetic peptide"
ARDDTARRVRGVPYYYYYAMDV

SEQ ID NO: 1498 - protein, 459 aa, Artificial Sequence; identical to SEQ ID NO: 1418
  source: /note="Description of Artificial Sequence: Synthetic polypeptide"

SEQ ID NO: 1499 - protein, 114 aa, Artificial Sequence
  source: /note="Description of Artificial Sequence: Synthetic polypeptide"
EIVMTQSPATLSLSPGERATLSCRASESVTTFLAWYQQKPGQAPRLLITDASNRATGIPGRFSGSGSGTDFTLTISSLEPEDFAVYYCHQHTNWPLTFGGGTKLEIKRTVAAPS

SEQ ID NO: 1500 - protein, 6 aa, Artificial Sequence
  source: /note="Description of Artificial Sequence: Synthetic peptide"
ESVTTF

SEQ ID NO: 1501 - protein, 3 aa, Artificial Sequence
  source: /note="Description of Artificial Sequence: Synthetic peptide"
DAS

SEQ ID NO: 1502 - protein, 9 aa, Artificial Sequence
  source: /note="Description of Artificial Sequence: Synthetic peptide"
HQHTNWPLT

SEQ ID NO: 1503 - protein, 214 aa, Artificial Sequence
  source: /note="Description of Artificial Sequence: Synthetic polypeptide"
EIVMTQSPATLSLSPGERATLSCRASESVTTFLAWYQQKPGQAPRLLITDASNRATGIPGRFSGSGSGTDFTLTISSLEPEDFAVYYCHQHTNWPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1504 - protein, 129 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVGYCSGGSCYISYYYGMDVWGQGTTVTVSS

SEQ ID NO: 1505 - protein, 8 aa, Artificial Sequence
  source: /note="Description of Artificial Sequence: Synthetic peptide"
GYTLTELS

SEQ ID NO: 1506 - protein, 8 aa, Artificial Sequence
  source: /note="Description of Artificial Sequence: Synthetic peptide"
FDPEDGET

SEQ ID NO: 1507 - protein, 22 aa, Artificial Sequence
  source: /note="Description of Artificial Sequence: Synthetic peptide"
ATEVGYCSGGSCYISYYYGMDV

SEQ ID NO: 1508 - protein, 459 aa, Artificial Sequence
  source: /note="Description of Artificial Sequence: Synthetic polypeptide"
EVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEVGYCSGGSCYISYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1509 - protein, 119 aa, Artificial Sequence
  source: /note="Description of Artificial Sequence: Synthetic polypeptide"
DVVMTQSPLSLPVTPGEPASISCRSSQSLLYRNGHNFLDWYVQKPGQSPQLLIYLGSNRASGVPDRFSGSGSGTDFTLKISRVEAEDVGVYYCMQALQTPPTFGQGTKLEIKRTVAAPS

SEQ ID NO: 1510 - protein, 11 aa, Artificial Sequence
  source: /note="Description of Artificial Sequence: Synthetic peptide"
QSLLYRNGHNF

SEQ ID NO: 1511 - protein, 3 aa, Artificial Sequence
  source: /note="Description of Artificial Sequence: Synthetic peptide"
LGS

SEQ ID NO: 1512 - protein, 9 aa, Artificial Sequence
  source: /note="Description of Artificial Sequence: Synthetic peptide"
MQALQTPPT

SEQ ID NO: 1513 - protein, 219 aa, Artificial Sequence
  source: /note="Description of Artificial Sequence: Synthetic polypeptide"
DVVMTQSPLSLPVTPGEPASISCRSSQSLLYRNGHNFLDWYVQKPGQSPQLLIYLGSNRASGVPDRFSGSGSGTDFTLKISRVEAEDVGVYYCMQALQTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1514 - protein, 121 aa, Artificial Sequence
  source: /note="Description of Artificial Sequence: Synthetic polypeptide"
DVQLVESGGDLVQPGGSRKLSCTASGFTFSNFGMHWVRQAPEKGLEWVAYISSGSSTIYYADTVKGRFTISRDNPENTLFLQMTSLRSEDTAMYYCTRLDYYTNSYSMDHWGQGTSVTVSS

SEQ ID NO: 1515 - protein, 8 aa, Artificial Sequence
  source: /note="Description of Artificial Sequence: Synthetic peptide"
GFTFSNFG

SEQ ID NO: 1516 - protein, 8 aa, Artificial Sequence
  source: /note="Description of Artificial Sequence: Synthetic peptide"
ISSGSSTI

SEQ ID NO: 1517 - protein, 14 aa, Artificial Sequence
  source: /note="Description of Artificial Sequence: Synthetic peptide"
TRLDYYTNSYSMDH

SEQ ID NO: 1518 - protein, 106 aa, Artificial Sequence
  source: /note="Description of Artificial Sequence: Synthetic polypeptide"
QIVLTQSPALMSASPGEKVTLTCSASSSLPYIYWYQQKPGSSPKPWIYLTSNLASGVPARFSGSRSGTSYSLTISSVEAEDAATYYCQQWSSNPFTFGSGTKLEIK

SEQ ID NO: 1519 - protein, 5 aa, Artificial Sequence
  source: /note="Description of Artificial Sequence: Synthetic peptide"
SSLPY

SEQ ID NO: 1520 - protein, 3 aa, Artificial Sequence
  source: /note="Description of Artificial Sequence: Synthetic peptide"
LTS

SEQ ID NO: 1521 - protein, 9 aa, Artificial Sequence
  source: /note="Description of Artificial Sequence: Synthetic peptide"
QQWSSNPFT

SEQ ID NO: 1522 - protein, 117 aa, Artificial Sequence
  source: /note="Description of Artificial Sequence: Synthetic polypeptide"
QVQLQQSGAELAKPGASVKMSCKASGYTFTSNWMHWVKQRPGQGLEWIGYINPSNGYTECNQKFRDKATLSADKSSSTAYMQLNSLTSADSAVYYCALMISAWLPYWGQGTLVTVSA

SEQ ID NO: 1523 - protein, 8 aa, Artificial Sequence
  source: /note="Description of Artificial Sequence: Synthetic peptide"
GYTFTSNW

SEQ ID NO: 1524 - protein, 8 aa, Artificial Sequence
  source: /note="Description of Artificial Sequence: Synthetic peptide"
INPSNGYT

SEQ ID NO: 1525 - protein, 10 aa, Artificial Sequence
  source: /note="Description of Artificial Sequence: Synthetic peptide"
ALMISAWLPY

SEQ ID NO: 1526 - protein, 111 aa, Artificial Sequence
  source: /note="Description of Artificial Sequence: Synthetic polypeptide"
DIVLTQSPASLAISLGQRATISCRASQSVSASSYSYVHWYQQKPGQPPKLLIKYASSLESGVPARFSGSGSGTDFTLNIHPVEEEDTATYYCLHTWEIPYTFGGGTKLEIK

SEQ ID NO: 1527 - protein, 10 aa, Artificial Sequence
  source: /note="Description of Artificial Sequence: Synthetic peptide"
QSVSASSYSY

SEQ ID NO: 1528 - protein, 3 aa, Artificial Sequence
  source: /note="Description of Artificial Sequence: Synthetic peptide"
YAS

SEQ ID NO: 1529 - protein, 9 aa, Artificial Sequence
  source: /note="Description of Artificial Sequence: Synthetic peptide"
LHTWEIPYT

SEQ ID NO: 1530 - protein, 116 aa, Artificial Sequence
  source: /note="Description of Artificial Sequence: Synthetic polypeptide"
QVQLQQSGAELTRPGASVNLSCKASGYTFTSYWMQWVKQRPGQGLEWIGAIYPGDGDTRFNQKFKGKATLTADESSSTAYMQLSSLASEDSAVYYCATYYRYDDYWGQGTTLTVSS

SEQ ID NO: 1531 - protein, 8 aa, Artificial Sequence
  source: /note="Description of Artificial Sequence: Synthetic peptide"
GYTFTSYW

SEQ ID NO: 1532 - protein, 8 aa, Artificial Sequence
  source: /note="Description of Artificial Sequence: Synthetic peptide"
IYPGDGDT

SEQ ID NO: 1533 - protein, 9 aa, Artificial Sequence
  source: /note="Description of Artificial Sequence: Synthetic peptide"
ATYYRYDDY

SEQ ID NO: 1534 - protein, 106 aa, Artificial Sequence
  source: /note="Description of Artificial Sequence: Synthetic polypeptide"
QIVLTQSPAIMSASPGEKVTMTCSASSSVSYMHWYQQKSGTSPKRWIYDTSKLASGVPTRFSGSGSGTSYSLTISSMEAEDAATYYCQQWSSNPYTFGGGTKLEIK

SEQ ID NO: 1535 - protein, 5 aa, Artificial Sequence
  source: /note="Description of Artificial Sequence: Synthetic peptide"
SSVSY

SEQ ID NO: 1536 - protein, 3 aa, Artificial Sequence
  source: /note="Description of Artificial Sequence: Synthetic peptide"
DTS

SEQ ID NO: 1537 - protein, 9 aa, Artificial Sequence
  source: /note="Description of Artificial Sequence: Synthetic peptide"
QQWSSNPYT

SEQ ID NO: 1538 - protein, 122 aa, Artificial Sequence
  source: /note="Description of Artificial Sequence: Synthetic polypeptide"
EVQLQQSGPDLVKPGASMKISCKASGYTFIDYNIHWVKQSQGKSLDWIGYIYPYNGGTGYNQKFKNKATLTVDSSSSTAYMEVRSLTFEDSAVYFCAREADYYGNRGQFDYWGQGTLVTVSA

SEQ ID NO: 1539 - protein, 8 aa, Artificial Sequence
  source: /note="Description of Artificial Sequence: Synthetic peptide"
GYTFIDYN

SEQ ID NO: 1540 - protein, 8 aa, Artificial Sequence
  source: /note="Description of Artificial Sequence: Synthetic peptide"
IYPYNGGT

SEQ ID NO: 1541 - protein, 15 aa, Artificial Sequence
  source: /note="Description of Artificial Sequence: Synthetic peptide"
AREADYYGNRGQFDY

SEQ ID NO: 1542 - protein, 107 aa, Artificial Sequence
  source: /note="Description of Artificial Sequence: Synthetic polypeptide"
DIQMTQSPASLSVSVGETVTITCRASENIFSNLAWYQQKQGKSPQLLVYGEANLADGVPSRFSGSGSGTQYSLKINSLQSEDFGNYYCQHFWGTPYTFGGGTTLEIK

SEQ ID NO: 1543 - protein, 6 aa, Artificial Sequence
  source: /note="Description of Artificial Sequence: Synthetic peptide"
ENIFSN

SEQ ID NO: 1544 - protein, 3 aa, Artificial Sequence
  source: /note="Description of Artificial Sequence: Synthetic peptide"
GEA

SEQ ID NO: 1545 - protein, 9 aa, Artificial Sequence
  source: /note="Description of Artificial Sequence: Synthetic peptide"
QHFWGTPYT

SEQ ID NO: 1546 - protein, 120 aa, Artificial Sequence
  source: /note="Description of Artificial Sequence: Synthetic polypeptide"
QVTLKESGPGILQPSQTLSLTCSFSGFSLNTSGTGVGWIRQPSGKGLEWLTHIWWNDNKFYNTFLKSRLTISKETSNNQVFLKIASVDTADAATYYCARMAYGNLWFVNWGQGTLVAVST

SEQ ID NO: 1547 - protein, 10 aa, Artificial Sequence
  source: /note="Description of Artificial Sequence: Synthetic peptide"
GFSLNTSGTG

SEQ ID NO: 1548 - protein, 7 aa, Artificial Sequence
  source: /note="Description of Artificial Sequence: Synthetic peptide"
IWWNDNK

SEQ ID NO: 1549 - protein, 12 aa, Artificial Sequence
  source: /note="Description of Artificial Sequence: Synthetic peptide"
ARMAYGNLWFVN

SEQ ID NO: 1550 - protein, 111 aa, Artificial Sequence
  source: /note="Description of Artificial Sequence: Synthetic polypeptide"
DIVLTQSPASLAVSLGQRASISCRASRSVTISGYSYMYWYQQKPGQPPRLLFYLASNLASGVPARFSGSGSGTDFTLNIHPVEEEDAAIYYCQHSRELPYTFGGGTKLEIK

SEQ ID NO: 1551 - protein, 10 aa, Artificial Sequence
  source: /note="Description of Artificial Sequence: Synthetic peptide"
RSVTISGYSY

SEQ ID NO: 1552 - protein, 3 aa, Artificial Sequence
  source: /note="Description of Artificial Sequence: Synthetic peptide"
LAS

SEQ ID NO: 1553 - protein, 9 aa, Artificial Sequence
  source: /note="Description of Artificial Sequence: Synthetic peptide"
QHSRELPYT

SEQ ID NO: 1554 - protein, 123 aa, Artificial Sequence
  source: /note="Description of Artificial Sequence: Synthetic polypeptide"
QIQLVQSGPELKKPRETVKISCKASGYTFTDYSMHWVKQAPGKGLKWMGWINTETGEPTYADDFKGRFAFSLEASASSAYLQINILKDEDTATYFCARSRGGYYEDYYALDYWGQGTSVTVSS

SEQ ID NO: 1555 - protein, 8 aa, Artificial Sequence
  source: /note="Description of Artificial Sequence: Synthetic peptide"
GYTFTDYS

SEQ ID NO: 1556 - protein, 8 aa, Artificial Sequence
  source: /note="Description of Artificial Sequence: Synthetic peptide"
INTETGEP

SEQ ID NO: 1557 - protein, 16 aa, Artificial Sequence
  source: /note="Description of Artificial Sequence: Synthetic peptide"
ARSRGGYYEDYYALDY

SEQ ID NO: 1558 - protein, 107 aa, Artificial Sequence
  source: /note="Description of Artificial Sequence: Synthetic polypeptide"
DIQMTQSPASLSASVGESVTITCRASGNIHYYLAWYQQKQGKSPQLLVYNAKNLADGVPSRFSGSGSGTQFSLKINSLQPEDFGSYYCQHFWISPPTFGGGTKLEIK

SEQ ID NO: 1559 - protein, 6 aa, Artificial Sequence
  source: /note="Description of Artificial Sequence: Synthetic peptide"
GNIHYY

SEQ ID NO: 1560 - protein, 3 aa, Artificial Sequence
  source: /note="Description of Artificial Sequence: Synthetic peptide"
NAK

SEQ ID NO: 1561 - protein, 9 aa, Artificial Sequence
  source: /note="Description of Artificial Sequence: Synthetic peptide"
QHFWISPPT

SEQ ID NO: 1562 - protein, 118 aa, Artificial Sequence
  source: /note="Description of Artificial Sequence: Synthetic polypeptide"
EVQLRQSGADLVKPGASVKLSCTASGFNIKDTYIDWVKQRPEQGLDWIGRIDPANGNTKYDPKFQGKATIITDTSSNTAYLQLSNLTSEDTAVYYCARYGSYPYFDYWGRGTTLAVSS

SEQ ID NO: 1563 - protein, 8 aa, Artificial Sequence
  source: /note="Description of Artificial Sequence: Synthetic peptide"
GFNIKDTY

SEQ ID NO: 1564 - protein, 8 aa, Artificial Sequence
  source: /note="Description of Artificial Sequence: Synthetic peptide"
IDPANGNT

SEQ ID NO: 1565 - protein, 11 aa, Artificial Sequence
  source: /note="Description of Artificial Sequence: Synthetic peptide"
ARYGSYPYFDY

SEQ ID NO: 1566 - protein, 107 aa, Artificial Sequence
  source: /note="Description of Artificial Sequence: Synthetic polypeptide"
SIVMTQTPKFLLISAGDRVTITCKASQSVRNDVAWYQQKPGQSPKLLMYYASNRYTGVPDRFTGSGYGTDFTFTISTVQAEDLAVYFCQQDYSSPPTFGGGTKLEIK

SEQ ID NO: 1567 - protein, 6 aa, Artificial Sequence
  source: /note="Description of Artificial Sequence: Synthetic peptide"
QSVRND

SEQ ID NO: 1568 - protein, 3 aa, Artificial Sequence
  source: /note="Description of Artificial Sequence: Synthetic peptide"
YAS

SEQ ID NO: 1569 - protein, 9 aa, Artificial Sequence
  source: /note="Description of Artificial Sequence: Synthetic peptide"
QQDYSSPPT

SEQ ID NO: 1570 - protein, 118 aa, Artificial Sequence
  source: /note="Description of Artificial Sequence: Synthetic polypeptide"
QVQLQQSGPELVRPGVSVKISCKVSGYTFTDYVMHWVKQSHAKSLEWIGIISPYSGNTNYNQNFKGKATMTVDKSSSTAYMALARLTSEDSAIYYCAREGDLPMFAYWGQGTLVTVSA

SEQ ID NO: 1571 - protein, 8 aa, Artificial Sequence
  source: /note="Description of Artificial Sequence: Synthetic peptide"
GYTFTDYV

SEQ ID NO: 1572 - protein, 8 aa, Artificial Sequence
  source: /note="Description of Artificial Sequence: Synthetic peptide"
ISPYSGNT

SEQ ID NO: 1573 - protein, 11 aa, Artificial Sequence
  source: /note="Description of Artificial Sequence: Synthetic peptide"
AREGDLPMFAY

SEQ ID NO: 1574 - protein, 106 aa, Artificial Sequence
  source: /note="Description of Artificial Sequence: Synthetic polypeptide"
QIVLTQSPTIMSASPGEKVTMTCSASSSVSYIYWYQQNPGSSPRLLIYDTSILASGVPFRFSGSGSGTSYSLTISRMEAEDAATYYCQQWTSYPLTFGSGTKLELK

SEQ ID NO: 1575 - protein, 5 aa, Artificial Sequence
  source: /note="Description of Artificial Sequence: Synthetic peptide"
SSVSY

SEQ ID NO: 1576 - protein, 3 aa, Artificial Sequence
  source: /note="Description of Artificial Sequence: Synthetic peptide"
DTS

SEQ ID NO: 1577 - protein, 9 aa, Artificial Sequence
  source: /note="Description of Artificial Sequence: Synthetic peptide"
QQWTSYPLT

SEQ ID NO: 1578 - protein, 120 aa, Artificial Sequence
  source: /note="Description of Artificial Sequence: Synthetic polypeptide"
EVQLQQSGPELVKPGASVKISCKASGYTFTDYNINWVKQSHGKSLEWIGYIYPYIGGSGYNQKFKSKATLSADNPSSTAYMELRSLTSEDSAVYYCAREDKTARNAMDYWGQGTPVTVSS

SEQ ID NO: 1579 - protein, 8 aa, Artificial Sequence
  source: /note="Description of Artificial Sequence: Synthetic peptide"
GYTFTDYN

SEQ ID NO: 1580 - protein, 8 aa, Artificial Sequence
  source: /note="Description of Artificial Sequence: Synthetic peptide"
IYPYIGGS

SEQ ID NO: 1581 - protein, 13 aa, Artificial Sequence
  source: /note="Description of Artificial Sequence: Synthetic peptide"
AREDKTARNAMDY

SEQ ID NO: 1582 - protein, 107 aa, Artificial Sequence
  source: /note="Description of Artificial Sequence: Synthetic polypeptide"
DIQMTQSPASLSVSVGETVTIICRVSENIYSNLAWYQQKQGKSPQLLVYEATNLAEGVPSRFSGSGSGTQYSLKINSLQSEDFGSYYCQHFWGTPYTFGGGTKLEIK

SEQ ID NO: 1583 - protein, 6 aa, Artificial Sequence
  source: /note="Description of Artificial Sequence: Synthetic peptide"
ENIYSN

SEQ ID NO: 1584 - protein, 3 aa, Artificial Sequence
  source: /note="Description of Artificial Sequence: Synthetic peptide"
EAT

SEQ ID NO: 1585 - protein, 9 aa, Artificial Sequence
  source: /note="Description of Artificial Sequence: Synthetic peptide"
QHFWGTPYT

SEQ ID NO: 1586 - protein, 120 aa, Artificial Sequence
  source: /note="Description of Artificial Sequence: Synthetic polypeptide"
DVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARHYRYPPYAMDYWGQGTSVTVSS

SEQ ID NO: 1587 - protein, 9 aa, Artificial Sequence
  source: /note="Description of Artificial Sequence: Synthetic peptide"
GYSITSDYA

SEQ ID NO: 1588 - protein, 7 aa, Artificial Sequence
  source: /note="Description of Artificial Sequence: Synthetic peptide"
ISYSGST

SEQ ID NO: 1589 - protein, 13 aa, Artificial Sequence
  source: /note="Description of Artificial Sequence: Synthetic peptide"
ARHYRYPPYAMDY

SEQ ID NO: 1590 - protein, 113 aa, Artificial Sequence
  source: /note="Description of Artificial Sequence: Synthetic polypeptide"
DIVMTQSPSSLAMSVGQKVTMSCKSSQSLLNSSNQKNYLAWYQQKPGQSPKLLVYFASTRESGVPDRFIGSGSGTDFTLTITSVQAEDLADYFCQQHYSTPFTFGSGTKLEIK

SEQ ID NO: 1591 - protein, 12 aa, Artificial Sequence
  source: /note="Description of Artificial Sequence: Synthetic peptide"
QSLLNSSNQKNY

SEQ ID NO: 1592 - protein, 3 aa, Artificial Sequence
  source: /note="Description of Artificial Sequence: Synthetic peptide"
FAS

SEQ ID NO: 1593 - protein, 9 aa, Artificial Sequence
  source: /note="Description of Artificial Sequence: Synthetic peptide"
QQHYSTPFT

SEQ ID NO: 1594 - protein, 118 aa, Artificial Sequence
  source: /note="Description of Artificial Sequence: Synthetic polypeptide"
QVQLKQSGPGLVQPSQSLSITCTVSGFSLTSFGVHWVRQSPGKGLEWLGVIWSGGTTVYDAAFISRLSISKDNSKSQVFFKMNSLQTNDTAIYYCARKRGNFYVMDYWGQGTSVTVSS

SEQ ID NO: 1595 - protein, 8 aa, Artificial Sequence
  source: /note="Description of Artificial Sequence: Synthetic peptide"
GFSLTSFG

SEQ ID NO: 1596 - protein, 7 aa, Artificial Sequence
  source: /note="Description of Artificial Sequence: Synthetic peptide"
IWSGGTT

SEQ ID NO: 1597 - protein, 12 aa, Artificial Sequence
  source: /note="Description of Artificial Sequence: Synthetic peptide"
ARKRGNFYVMDY

SEQ ID NO: 1598 - protein, 113 aa, Artificial Sequence; identical to SEQ ID NO: 1590
  source: /note="Description of Artificial Sequence: Synthetic polypeptide"

SEQ ID NO: 1599 - protein, 12 aa, Artificial Sequence
  source: /note="Description of Artificial Sequence: Synthetic peptide"
QSLLNSSNQKNY

SEQ ID NO: 1600 - protein, 3 aa, Artificial Sequence
  source: /note="Description of Artificial Sequence: Synthetic peptide"
FAS

SEQ ID NO: 1601 - protein, 9 aa, Artificial Sequence
  source: /note="Description of Artificial Sequence: Synthetic peptide"
QQHYSTPFT

SEQ ID NO: 1602 - protein, 118 aa, Artificial Sequence
  source: /note="Description of Artificial Sequence: Synthetic polypeptide"
QVQLQQPGSELVRPGTSVKLSCKASGYTFTSYWVHWVRQRHGQGLEWIGNVYPGSGSTNYDEKFKSKGTLTVDTSSSTAYMHLSSLTSEDSAVYYCTRGVLRFPLDYWGQGTTLTVSS

SEQ ID NO: 1603 - protein, 8 aa, Artificial Sequence
  source: /note="Description of Artificial Sequence: Synthetic peptide"
GYTFTSYW

SEQ ID NO: 1604 - protein, 8 aa, Artificial Sequence
  source: /note="Description of Artificial Sequence: Synthetic peptide"
VYPGSGST

SEQ ID NO: 1605 - protein, 11 aa, Artificial Sequence
  source: /note="Description of Artificial Sequence: Synthetic peptide"
TRGVLRFPLDY

SEQ ID NO: 1606 - protein, 112 aa, Artificial Sequence
  source: /note="Description of Artificial Sequence: Synthetic polypeptide"
DIVMTQAAPSVPVTPGESVSISCRSSKSLLHSNGNTYLYWFLQRPGQSPHLLIYRMSNLASGVPDRFSGSGSGTAFTLRISRVEAEDVGVYYCMQHLEYPLTFGAGTKLELK

SEQ ID NO: 1607 - protein, 11 aa, Artificial Sequence
  source: /note="Description of Artificial Sequence: Synthetic peptide"
KSLLHSNGNTY

SEQ ID NO: 1608 - protein, 3 aa, Artificial Sequence
  source: /note="Description of Artificial Sequence: Synthetic peptide"
RMS

SEQ ID NO: 1609 - protein, 9 aa, Artificial Sequence
  source: /note="Description of Artificial Sequence: Synthetic peptide"
MQHLEYPLT

SEQ ID NO: 1610 - protein, 118 aa, Artificial Sequence
  source: /note="Description of Artificial Sequence: Synthetic polypeptide"
QVQLQQSGPEVVRPGVSVKISCKGSGYKFPDYVMHWVKQSHAKSLEWIGIISIYSGNTNYNQKFKGKATMTVDKSSSTAYMELARLTSEDSAIYYCAREGDLPMFAYWGQGTLVTVSA

SEQ ID NO: 1611 - protein, 8 aa, Artificial Sequence
  source: /note="Description of Artificial Sequence: Synthetic peptide"
GYKFPDYV

SEQ ID NO: 1612 - protein, 8 aa, Artificial Sequence
  source: /note="Description of Artificial Sequence: Synthetic peptide"
ISIYSGNT

SEQ ID NO: 1613 - protein, 11 aa, Artificial Sequence
  source: /note="Description of Artificial Sequence: Synthetic peptide"
AREGDLPMFAY

SEQ ID NO: 1614 - protein, 106 aa, Artificial Sequence
  source: /note="Description of Artificial Sequence: Synthetic polypeptide"
QIVLTQSPAIMSASPGEKVTMTCNASSSVSYMYWYQQKPISSPRLLIYDTSNLASGVPVRFSGSGSGTSYSLTIGRMEAEDAATYYCQQWSSYPLTFGAGTKVEVK

SEQ ID NO: 1615 - protein, 5 aa, Artificial Sequence
  source: /note="Description of Artificial Sequence: Synthetic peptide"
SSVSY

SEQ ID NO: 1616 - protein, 3 aa, Artificial Sequence
  source: /note="Description of Artificial Sequence: Synthetic peptide"
DTS

SEQ ID NO: 1617 - protein, 9 aa, Artificial Sequence
  source: /note="Description of Artificial Sequence: Synthetic peptide"
QQWSSYPLT

SEQ ID NO: 1618 - protein, 122 aa, Artificial Sequence
  source: /note="Description of Artificial Sequence: Synthetic polypeptide"
QVQLKESGPGLVAPSQSLSITCTVSGFSLTAYNINWVRQPPGKGLEWLGMIWGDGNTDYNSPLKSRLTISKDNSKSQVFLKMDSLQTDDTARYYCARDLKVRRDSPYTMDYWGQGTSVTVSS

SEQ ID NO: 1619 - protein, 8 aa, Artificial Sequence
  source: /note="Description of Artificial Sequence: Synthetic peptide"
GFSLTAYN

SEQ ID NO: 1620 - protein, 7 aa, Artificial Sequence
  source: /note="Description of Artificial Sequence: Synthetic peptide"
IWGDGNT

SEQ ID NO: 1621 - protein, 16 aa, Artificial Sequence
  source: /note="Description of Artificial Sequence: Synthetic peptide"
ARDLKVRRDSPYTMDY

SEQ ID NO: 1622 - protein, 112 aa, Artificial Sequence
  source: /note="Description of Artificial Sequence: Synthetic polypeptide"
NIMMTQSPSSLAVSAGEKVTMSCKSSQSVLYSSNQKNYLAWYQQKPGQSPKLLIYWASNRESGVPDRFTGSGSGTDFTLTISSVQAEDLAVYYCHQYLSSYTFGGGTKLEIK

SEQ ID NO: 1623 - protein, 12 aa, Artificial Sequence
  source: /note="Description of Artificial Sequence: Synthetic peptide"
QSVLYSSNQKNY

SEQ ID NO: 1624 - protein, 3 aa, Artificial Sequence
  source: /note="Description of Artificial Sequence: Synthetic peptide"
WAS

SEQ ID NO: 1625 - protein, 8 aa, Artificial Sequence
  source: /note="Description of Artificial Sequence: Synthetic peptide"
HQYLSSYT

SEQ ID NO: 1626 - protein, 124 aa, Artificial Sequence
  source: /note="Description of Artificial Sequence: Synthetic polypeptide"
DVQLQESGPGLVKPSQSLSLTCTVTGYSLTSDYAWNWIRQFPGNKLEWMGYITYSGGTTYNPSLKSRISITRDTSKNQFFLQLTSVTTEDTATYYCARRGSGTTVVGDWYFDVWGAGTTVTVSS

SEQ ID NO: 1627 - protein, 9 aa, Artificial Sequence
  source: /note="Description of Artificial Sequence: Synthetic peptide"
GYSLTSDYA

SEQ ID NO: 1628 - protein, 7 aa, Artificial Sequence
  source: /note="Description of Artificial Sequence: Synthetic peptide"
ITYSGGT

SEQ ID NO: 1629 - protein, 17 aa, Artificial Sequence
  source: /note="Description of Artificial Sequence: Synthetic peptide"
ARRGSGTTVVGDWYFDV

SEQ ID NO: 1630 - protein, 113 aa, Artificial Sequence
  source: /note="Description of Artificial Sequence: Synthetic polypeptide"
DIVMSQSPSSLAVSVGEKVTMSCKSSQSLLYSFNQKYYLAWYQQKPGQSPKLLIYWASTRESGVPDRFTGSGSGTDFTPTISSVTAEDLAVYYCQQFYTYPYTFGGGTKLEMK

SEQ ID NO: 1631 - protein, 12 aa, Artificial Sequence
  source: /note="Description of Artificial Sequence: Synthetic peptide"
QSLLYSFNQKYY

SEQ ID NO: 1632 - protein, 3 aa, Artificial Sequence
  source: /note="Description of Artificial Sequence: Synthetic peptide"
WAS

SEQ ID NO: 1633 - protein, 9 aa, Artificial Sequence
  source: /note="Description of Artificial Sequence: Synthetic peptide"
QQFYTYPYT

SEQ ID NO: 1634 - protein, 122 aa, Artificial Sequence
  source: /note="Description of Artificial Sequence: Synthetic polypeptide"
EVQVQQSGPELVKPGASVKISCKASGYTFTKSNMHWVKQSHGKSLEWIGYIYPYNGGTGYNQNFKSKATLTVDISSSTAYMELRSLTLEDSAVYLCAREADYYGNRGQFDYWGQGTLVTVSA

SEQ ID NO: 1635 - protein, 8 aa, Artificial Sequence
  source: /note="Description of Artificial Sequence: Synthetic peptide"
GYTFTKSN

SEQ ID NO: 1636 - protein, 8 aa, Artificial Sequence
  source: /note="Description of Artificial Sequence: Synthetic peptide"
IYPYNGGT

SEQ ID NO: 1637 - protein, 15 aa, Artificial Sequence
  source: /note="Description of Artificial Sequence: Synthetic peptide"
AREADYYGNRGQFDY

SEQ ID NO: 1638 - protein, 107 aa, Artificial Sequence
  source: /note="Description of Artificial Sequence: Synthetic polypeptide"
DIQMTQSPASLSVSVGETVTITCRASDNIFSNLAWYHQKQGKSPHLLVYGATNLADGVPSRFSGSGSGTQYSLKINSLQSEDFGDYYCQHFWGTPYTFGGGTKLEIK

SEQ ID NO: 1639 - protein, 6 aa, Artificial Sequence
  source: /note="Description of Artificial Sequence: Synthetic peptide"
DNIFSN

SEQ ID NO: 1640 - protein, 3 aa, Artificial Sequence
  source: /note="Description of Artificial Sequence: Synthetic peptide"
GAT

SEQ ID NO: 1641 - protein, 9 aa, Artificial Sequence
  source: /note="Description of Artificial Sequence: Synthetic peptide"
QHFWGTPYT

SEQ ID NO: 1642 - protein, 119 aa, Artificial Sequence
  source: /note="Description of Artificial Sequence: Synthetic polypeptide"
QVQLQQSGAELMRPGTSVKVSCKASGYAFTNHLIEWIKQRPGQGLEWIGVINPGSDSTDYNEKFKDKATLTADKSSSTAYMQLSSLTSDDSAVYFCARSLYYNSWFVYWGQGTLVTVSA

SEQ ID NO: 1643 - protein, 8 aa, Artificial Sequence
  source: /note="Description of Artificial Sequence: Synthetic peptide"
GYAFTNHL

SEQ ID NO: 1644 - protein, 8 aa, Artificial Sequence
  source: /note="Description of Artificial Sequence: Synthetic peptide"
INPGSDST

SEQ ID NO: 1645 - protein, 12 aa, Artificial Sequence
  source: /note="Description of Artificial Sequence: Synthetic peptide"
ARSLYYNSWFVY

SEQ ID NO: 1646 - protein, 107 aa, Artificial Sequence
  source: /note="Description of Artificial Sequence: Synthetic polypeptide"
DIQMTQSPASLSASVGETVTITCRASENIYSYLAWYQQKRGKSPQLLVYNAKTLVEGVPSRFSGSGSGTQFSLKINSLQPEDFGSYYCQHHYGTPYTFGGGTKLEIK

SEQ ID NO: 1647 - protein, 6 aa, Artificial Sequence
  source: /note="Description of Artificial Sequence: Synthetic peptide"
ENIYSY

SEQ ID NO: 1648 - protein, 3 aa, Artificial Sequence
  source: /note="Description of Artificial Sequence: Synthetic peptide"
NAK

SEQ ID NO: 1649 - protein, 9 aa, Artificial Sequence
  source: /note="Description of Artificial Sequence: Synthetic peptide"
QHHYGTPYT

SEQ ID NO: 1650 - protein, 118 aa, Artificial Sequence
  source: /note="Description of Artificial Sequence: Synthetic polypeptide"
EVQLQQSGAELVKPGASVRLSCTASGFSIRDTYIHWVKQRPEQGLDWIGKIDPANGKSEYDPKFQGRATMTTDTSSNTAYLQLSSLTSEDTAVYYCTRYGYYPYFDVWGAGTTVTVFS

SEQ ID NO: 1651 - protein, 8 aa, Artificial Sequence
  source: /note="Description of Artificial Sequence: Synthetic peptide"
GFSIRDTY

SEQ ID NO: 1652 - protein, 8 aa, Artificial Sequence
  source: /note="Description of Artificial Sequence: Synthetic peptide"
IDPANGKS

SEQ ID NO: 1653 - protein, 11 aa, Artificial Sequence
  source: /note="Description of Artificial Sequence: Synthetic peptide"
TRYGYYPYFDV

SEQ ID NO: 1654 - protein, 107 aa, Artificial Sequence
  source: /note="Description of Artificial Sequence: Synthetic polypeptide"
SIVMTQTPKFLLVSAGDRVAITCKASQSVRHDVVWYQQKPGQSPKLLIYYASSRYTGVPDRFTGSGYGTDFTFTISTVQAEDLALYFCLQDFSSPWTFGGGTKLEIK

SEQ ID NO: 1655 - protein, 6 aa, Artificial Sequence
  source: /note="Description of Artificial Sequence: Synthetic peptide"
QSVRHD

SEQ ID NO: 1656 - protein, 3 aa, Artificial Sequence
  source: /note="Description of Artificial Sequence: Synthetic peptide"
YAS

SEQ ID NO: 1657 - protein, 9 aa, Artificial Sequence
  source: /note="Description of Artificial Sequence: Synthetic peptide"
LQDFSSPWT

SEQ ID NO: 1658 - protein, 120 aa, Artificial Sequence
  source: /note="Description of Artificial Sequence: Synthetic polypeptide"
EVQLQQSGPELVKPGASVKISCKTSGYTFTKNTMHWVRQSHGKSLEWIGGINPNSGGASFNQKFMGKATLTVDKSSSTAYMELRSLTSEDSAVYYCARDGYDGDWFFDVWGAGTTVTVSS

SEQ ID NO: 1659 - protein, 8 aa, Artificial Sequence
  source: /note="Description of Artificial Sequence: Synthetic peptide"
GYTFTKNT

SEQ ID NO: 1660 - protein, 8 aa, Artificial Sequence
  source: /note="Description of Artificial Sequence: Synthetic peptide"
INPNSGGA

SEQ ID NO: 1661 - protein, 13 aa, Artificial Sequence
  source: /note="Description of Artificial Sequence: Synthetic peptide"
ARDGYDGDWFFDV

SEQ ID NO: 1662 - protein, 107 aa, Artificial Sequence
  source: /note="Description of Artificial Sequence: Synthetic polypeptide"
DIQMNQSPFSLSASLGDTVTITCHASQNIYVWLSWYQQKPGNIPKLLIYKASDLHTGVPSRFSGSGSGTDFTLNISSLQPEDIATYYCQQGQSYPRTFGGGTKLEIK

SEQ ID NO: 1663 - protein, 6 aa, Artificial Sequence
  source: /note="Description of Artificial Sequence: Synthetic peptide"
QNIYVW

SEQ ID NO: 1664 - protein, 3 aa, Artificial Sequence
  source: /note="Description of Artificial Sequence: Synthetic peptide"
KAS

SEQ ID NO: 1665 - protein, 9 aa, Artificial Sequence
  source: /note="Description of Artificial Sequence: Synthetic peptide"
QQGQSYPRT

SEQ ID NO: 1666 - protein, 114 aa, Artificial Sequence
  source: /note="Description of Artificial Sequence: Synthetic polypeptide"
QVQLKESGPGLVAPSQSLSITCTVSGFSLIGHGVNWIRQPPGKGLEWLGVIWGDGNTDYNSALKSRLSISKDNSKSQVFLKMNSLQTDDTARYFCAVNSAMDYWGQGTAVTVSS

SEQ ID NO: 1667 - protein, 8 aa, Artificial Sequence
  source: /note="Description of Artificial Sequence: Synthetic peptide"
GFSLIGHG

SEQ ID NO: 1668 - protein, 7 aa, Artificial Sequence
  source: /note="Description of Artificial Sequence: Synthetic peptide"
IWGDGNT

SEQ ID NO: 1669 - protein, 8 aa, Artificial Sequence
  source: /note="Description of Artificial Sequence: Synthetic peptide"
AVNSAMDY

SEQ ID NO: 1670 - protein, 107 aa, Artificial Sequence
  source: /note="Description of Artificial Sequence: Synthetic polypeptide"
NIVMTQSPKSMSMSVGERVTLNCTASENVASFVSWYQQKPEQSPKLLIYGTSNRYTGVPDRFTGSGSATDFTLTISSVQAEDLGDYHCGQSYNYPFTFGSGTKLEIE

SEQ ID NO: 1671 - protein, 6 aa, Artificial Sequence
  source: /note="Description of Artificial Sequence: Synthetic peptide"
ENVASF

SEQ ID NO: 1672 - protein, 3 aa, Artificial Sequence
  source: /note="Description of Artificial Sequence: Synthetic peptide"
GTS

SEQ ID NO: 1673 - protein, 9 aa, Artificial Sequence
  source: /note="Description of Artificial Sequence: Synthetic peptide"
GQSYNYPFT

SEQ ID NO: 1674 - protein, 119 aa, Artificial Sequence
  source: /note="Description of Artificial Sequence: Synthetic polypeptide"
QVQLQQSGAELVRPGASVKVSCKTSGYAFTNYLIEWVKQRPGQGLEWIGVINPGSGGIYYNDKFKVKTTLTADKSSSTAYMQLSSLTSDDSAVYFCARSETHDTWFAYWGQGTLVTVSA

SEQ ID NO: 1675 - protein, 8 aa, Artificial Sequence
  source: /note="Description of Artificial Sequence: Synthetic peptide"
GYAFTNYL

SEQ ID NO: 1676 - protein, 8 aa, Artificial Sequence
  source: /note="Description of Artificial Sequence: Synthetic peptide"
INPGSGGI

SEQ ID NO: 1677 - protein, 12 aa, Artificial Sequence
  source: /note="Description of Artificial Sequence: Synthetic peptide"
ARSETHDTWFAY

SEQ ID NO: 1678 - protein, 108 aa, Artificial Sequence
  source: /note="Description of Artificial Sequence: Synthetic polypeptide"
DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIKR

SEQ ID NO: 1679 - protein, 6 aa, Artificial Sequence
  source: /note="Description of Artificial Sequence: Synthetic peptide"
QSVRIA

SEQ ID NO: 1680 - protein, 3 aa, Artificial Sequence
  source: /note="Description of Artificial Sequence: Synthetic peptide"
LAS

SEQ ID NO: 1681 - protein, 9 aa, Artificial Sequence
  source: /note="Description of Artificial Sequence: Synthetic peptide"
LQHWNYPYT

SEQ ID NO: 1682 - protein, 120 aa, Artificial Sequence
  source: /note="Description of Artificial Sequence: Synthetic polypeptide"
QVQLQQSGAELVRPGTSVKMSCKAAGYTFTNYWIGWVKQRPGHGLEWIGDIYPGGGYTNYNEKFKGKATLTADTSSSTAYMQLSSLTSEDSAIYYCASPYYGSSYGFAFWGQGTLVTVSA

SEQ ID NO: 1683 - protein, 8 aa, Artificial Sequence
  source: /note="Description of Artificial Sequence: Synthetic peptide"
GYTFTNYW

SEQ ID NO: 1684 - protein, 8 aa, Artificial Sequence
  source: /note="Description of Artificial Sequence: Synthetic peptide"
IYPGGGYT

SEQ ID NO: 1685 - protein, 13 aa, Artificial Sequence
  source: /note="Description of Artificial Sequence: Synthetic peptide"
ASPYYGSSYGFAF

SEQ ID NO: 1686 - protein, 108 aa, Artificial Sequence; identical to SEQ ID NO: 1678
  source: /note="Description of Artificial Sequence: Synthetic polypeptide"

SEQ ID NO: 1687 - protein, 6 aa, Artificial Sequence
  source: /note="Description of Artificial Sequence: Synthetic peptide"
QSVRIA

SEQ ID NO: 1688 - protein, 3 aa, Artificial Sequence
  source: /note="Description of Artificial Sequence: Synthetic peptide"
LAS

SEQ ID NO: 1689 - protein, 9 aa, Artificial Sequence
  source: /note="Description of Artificial Sequence: Synthetic peptide"
LQHWNYPYT

SEQ ID NO: 1690 - protein, 117 aa, Artificial Sequence
  source: /note="Description of Artificial Sequence: Synthetic polypeptide"
QVQLKESGPGLVAPSQSLSITCTVSGFSLSGYGIKWVRQPPGKGLEWLGTIWGDGSTDYNSALKSRLSISKDNSKSQVFLKMTSLQTDDTARYYCASDSLGITFGYWGQGTLVTVSA

SEQ ID NO: 1691 - protein, 8 aa, Artificial Sequence
  source: /note="Description of Artificial Sequence: Synthetic peptide"
GFSLSGYG

SEQ ID NO: 1692 - protein, 7 aa, Artificial Sequence
  source: /note="Description of Artificial Sequence: Synthetic peptide"
IWGDGST

SEQ ID NO: 1693 - protein, 11 aa, Artificial Sequence
  source: /note="Description of Artificial Sequence: Synthetic peptide"
ASDSLGITFGY

SEQ ID NO: 1694 - protein, 107 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPLTFGAGTKLELK

SEQ ID NO: 1695 - protein, 6 aa, Artificial Sequence
  source: /note="Description of Artificial Sequence: Synthetic peptide"
QDISNY

SEQ ID NO: 1696 - protein, 3 aa, Artificial Sequence
  source: /note="Description of Artificial Sequence: Synthetic peptide"
YTS

SEQ ID NO: 1697 - protein, 9 aa, Artificial Sequence
  source: /note="Description of Artificial Sequence: Synthetic peptide"
QQGNTLPLT

SEQ ID NO: 1698 - protein, 120 aa, Artificial Sequence
  source: /note="Description of Artificial Sequence: Synthetic polypeptide"
QVQLKESGPGLVAPSQSLSITCTVSGFSLTSYAITWVRQPPGKGLEWLGVIWPGGGTNYNSALKSRLSISKDNSKSHLFLKMNSLQTDDTARYYCVRSYDGYLDWYFDVWGTGTTVTVSS

SEQ ID NO: 1699 - protein, 8 aa, Artificial Sequence
  source: /note="Description of Artificial Sequence: Synthetic peptide"
GFSLTSYA

SEQ ID NO: 1700 - protein, 7 aa, Artificial Sequence
  source: /note="Description of Artificial Sequence: Synthetic peptide"
IWPGGGT

SEQ ID NO: 1701 - protein, 14 aa, Artificial Sequence
  source: /note="Description of Artificial Sequence: Synthetic peptide"
VRSYDGYLDWYFDV

SEQ ID NO: 1702 - protein, 107 aa, Artificial Sequence
  source: /note="Description of Artificial Sequence: Synthetic polypeptide"
NIVMTQSPKSMSMSVGERVTLSCKASENVGTYVSWYQQKPDQSPKLLIYGASNRYTGVPDRFTGSGSATDFTLIISSVQAEDLSDYHCGQSYSYPYTFGGGTKLEII

SEQ ID NO: 1703 - protein, 6 aa, Artificial Sequence
  source: /note="Description of Artificial Sequence: Synthetic peptide"
ENVGTY

SEQ ID NO: 1704 - protein, 3 aa, Artificial Sequence
  source: /note="Description of Artificial Sequence: Synthetic peptide"
GAS

SEQ ID NO: 1705 - protein, 9 aa, Artificial Sequence
  source: /note="Description of Artificial Sequence: Synthetic peptide"
GQSYSYPYT

SEQ ID NO: 1706 - protein, 123 aa, Artificial Sequence
  source: /note="Description of Artificial Sequence: Synthetic polypeptide"
QIQLVQSGPDLKKPGETVKISCKASGYTFTTYGMSWVKQAPGRGLKWMGWINTYSGVSTFPDDFKGRFAFSLETSASTAYLQINNLKNEDSATYFCARLGMGSTTGAGYFDVWGTGTTVTVSS

SEQ ID NO: 1707 - protein, 8 aa, Artificial Sequence
  source: /note="Description of Artificial Sequence: Synthetic peptide"
GYTFTTYG

SEQ ID NO: 1708 - protein, 8 aa, Artificial Sequence
  source: /note="Description of Artificial Sequence: Synthetic peptide"
INTYSGVS

SEQ ID NO: 1709 - protein, 16 aa, Artificial Sequence
  source: /note="Description of Artificial Sequence: Synthetic peptide"
ARLGMGSTTGAGYFDV

SEQ ID NO: 1710 - protein, 108 aa, Artificial Sequence
  source: /note="Description of Artificial Sequence: Synthetic polypeptide"
DIVLTQSPAIMSASPGEKVTMTCSASSSVSSWYLHWYQQKSGASPKLWIYGTSNLASGVPARFSGSGSGTSYSLTISSVEAEDAATYYCQQYRSDPYTFGSGTKLEIK

SEQ ID NO: 1711 - protein, 7 aa, Artificial Sequence
  source: /note="Description of Artificial Sequence: Synthetic peptide"
SSVSSWY

SEQ ID NO: 1712 - protein, 3 aa, Artificial Sequence
  source: /note="Description of Artificial Sequence: Synthetic peptide"
GTS

SEQ ID NO: 1713 - protein, 9 aa, Artificial Sequence
  source: /note="Description of Artificial Sequence: Synthetic peptide"
QQYRSDPYT

SEQ ID NO: 1714 - protein, 123 aa, Artificial Sequence
  source: /note="Description of Artificial Sequence: Synthetic polypeptide"
QIQLVQSGPELKKPGETVKISCKASGYTFTTYGMSWVKQAPGKGLKWMGWINTYSGVSTYADDFEGRFAFSLETSVSTAYLQINNLKNEDTATYFCARLGRGSTTGAGYLDVWGTGTTVTVSS

SEQ ID NO: 1715 - protein, 8 aa, Artificial Sequence
  source: /note="Description of Artificial Sequence: Synthetic peptide"
GYTFTTYG

SEQ ID NO: 1716 - protein, 8 aa, Artificial Sequence
  source: /note="Description of Artificial Sequence: Synthetic peptide"
INTYSGVS

SEQ ID NO: 1717 - protein, 16 aa, Artificial Sequence
  source: /note="Description of Artificial Sequence: Synthetic peptide"
ARLGRGSTTGAGYLDV

SEQ ID NO: 1718 - protein, 108 aa, Artificial Sequence
  source: /note="Description of Artificial Sequence: Synthetic polypeptide"
DIVLTQSPAIMSASPGEKVSMTCSASSSVSSWYLHWYQQKSGASPKLWIYGTSNLASGVPARFSGSGSGTSYSLTISSVEAEDAATYYCQQYHSDPYTFGSGTKLEIK

SEQ ID NO: 1719 - protein, 7 aa, Artificial Sequence
  source: /note="Description of Artificial Sequence: Synthetic peptide"
SSVSSWY

SEQ ID NO: 1720 - protein, 3 aa, Artificial Sequence
  source: /note="Description of Artificial Sequence: Synthetic peptide"
GTS

SEQ ID NO: 1721 - protein, 9 aa, Artificial Sequence
  source: /note="Description of Artificial Sequence: Synthetic peptide"
QQYHSDPYT

SEQ ID NO: 1722 - protein, 123 aa, Artificial Sequence; identical to SEQ ID NO: 1706
  source: /note="Description of Artificial Sequence: Synthetic polypeptide"

SEQ ID NO: 1723 - protein, 8 aa, Artificial Sequence
  source: /note="Description of Artificial Sequence: Synthetic peptide"
GYTFTTYG

SEQ ID NO: 1724 - protein, 8 aa, Artificial Sequence
  source: /note="Description of Artificial Sequence: Synthetic peptide"
INTYSGVS

SEQ ID NO: 1725 - protein, 16 aa, Artificial Sequence
  source: /note="Description of Artificial Sequence: Synthetic peptide"
ARLGMGSTTGAGYFDV

SEQ ID NO: 1726 - protein, 106 aa, Artificial Sequence
  source: /note="Description of Artificial Sequence: Synthetic polypeptide"
ENVLTQSPAIMSASLGEKVTLSCRASSSVNYMYWYQQKSDASPKLWIYYTSNLAPGVPARFSGSGSGNSYSLTISSVEGEDAATYYCQQFTSSPWTFGGGTKLEIK

SEQ ID NO: 1727 - protein, 5 aa, Artificial Sequence
  source: /note="Description of Artificial Sequence: Synthetic peptide"
SSVNY

SEQ ID NO: 1728 - protein, 3 aa, Artificial Sequence
  source: /note="Description of Artificial Sequence: Synthetic peptide"
YTS

SEQ ID NO: 1729 - protein, 9 aa, Artificial Sequence
  source: /note="Description of Artificial Sequence: Synthetic peptide"
QQFTSSPWT

SEQ ID NO: 1730 - protein, 114 aa, Artificial Sequence
  source: /note="Description of Artificial Sequence: Synthetic polypeptide"
EVQLQQSGPELVKPGASVKISCKASGYTFTDYSMNWVKQSHGKSLEWIGDITPNNGSPNYNQKFKDKATLTVDKSSSTVYMELRSLTSEDSAVYYCASLFFDYWGHGTTLTVSS

SEQ ID NO: 1731 - protein, 8 aa, Artificial Sequence
  source: /note="Description of Artificial Sequence: Synthetic peptide"
GYTFTDYS

SEQ ID NO: 1732 - protein, 8 aa, Artificial Sequence
  source: /note="Description of Artificial Sequence: Synthetic peptide"
ITPNNGSP

SEQ ID NO: 1733 - protein, 7 aa, Artificial Sequence
  source: /note="Description of Artificial Sequence: Synthetic peptide"
ASLFFDY

SEQ ID NO: 1734 - protein, 113 aa, Artificial Sequence
  source: /note="Description of Artificial Sequence: Synthetic polypeptide"
DIVMTQSPSSLSVSAGEKVTMSCKSSQSLLNSGNQKNYLAWYQQKPGQPPKLLIYGASTRDSGVPDRFTGSGSGTDFTLTITSVQAEDLAVYYCQNDHTYPYTFGGGTKLEIK

SEQ ID NO: 1735 - protein, 12 aa, Artificial Sequence
  source: /note="Description of Artificial Sequence: Synthetic peptide"
QSLLNSGNQKNY

SEQ ID NO: 1736 - protein, 3 aa, Artificial Sequence
  source: /note="Description of Artificial Sequence: Synthetic peptide"
GAS

SEQ ID NO: 1737 - protein, 9 aa, Artificial Sequence
  source: /note="Description of Artificial Sequence: Synthetic peptide"
QNDHTYPYT

SEQ ID NO: 1738 - protein, 120 aa, Artificial Sequence
  source: /note="Description of Artificial Sequence: Synthetic polypeptide"
QVQLQQPGTELVKPGASVKLSCKASGFTFTTHWMHWVRQRPGQGLEWIGNIYPSNGGSNYNEKFKTKATLTVDRSSSTAYMHLSSLTSEDSAVYYCARRVNWDGYYFDYWGQGTTLTVSS

SEQ ID NO: 1739 - protein, 8 aa, Artificial Sequence
  source: /note="Description of Artificial Sequence: Synthetic peptide"
GFTFTTHW

SEQ ID NO: 1740 - protein, 8 aa, Artificial Sequence
  source: /note="Description of Artificial Sequence: Synthetic peptide"
IYPSNGGS

SEQ ID NO: 1741 - protein, 13 aa, Artificial Sequence
  source: /note="Description of Artificial Sequence: Synthetic peptide"
ARRVNWDGYYFDY

SEQ ID NO: 1742 - protein, 107 aa, Artificial Sequence
  source: /note="Description of Artificial Sequence: Synthetic polypeptide"
DIVMTQSQKFMSTSVGDRVSVTCKASQNVGTNVAWYQQKPGQSPKLLIYSASYRYSGVPDRFTGSGSGTDFTLTISNVQSEDLADYFCQQYNSYPLTFGGGTKLEIK

SEQ ID NO: 1743 - protein, 6 aa, Artificial Sequence
  source: /note="Description of Artificial Sequence: Synthetic peptide"
QNVGTN

SEQ ID NO: 1744 - protein, 3 aa, Artificial Sequence
  source: /note="Description of Artificial Sequence: Synthetic peptide"
SAS

SEQ ID NO: 1745 - protein, 9 aa, Artificial Sequence
  source: /note="Description of Artificial Sequence: Synthetic peptide"
QQYNSYPLT

SEQ ID NO: 1746 - protein, 118 aa, Artificial Sequence
  source: /note="Description of Artificial Sequence: Synthetic polypeptide"
QVQLQESGTELVKPGASVKLSCKASGYTFTSYWIHWVKQRPGQGLEWIGNINPSNGGTNYNEKFKSKAALTVDKSSSTAYMQLSSLTSEDSAVYYCARRGLPYFFDYWGQGTTLTVSS

SEQ ID NO: 1747 - protein, 8 aa, Artificial Sequence
  source: /note="Description of Artificial Sequence: Synthetic peptide"
GYTFTSYW

SEQ ID NO: 1748 - protein, 8 aa, Artificial Sequence
  source: /note="Description of Artificial Sequence: Synthetic peptide"
INPSNGGT

SEQ ID NO: 1749 - protein, 11 aa, Artificial Sequence
  source: /note="Description of Artificial Sequence: Synthetic peptide"
ARRGLPYFFDY

SEQ ID NO: 1750 - protein, 107 aa, Artificial Sequence
  source: /note="Description of Artificial Sequence: Synthetic polypeptide"
DIVMTQSQKFMSTSVGDRVSVTCKGSQNVGYNVAWYQQKPGQSPKALVYSASDRHSGVPDRFAGSGSGTDFTLTISNVQSEDLAEYFCQQYNSYPLTFGAGTKLELK

SEQ ID NO: 1751 - protein, 6 aa, Artificial Sequence
  source: /note="Description of Artificial Sequence: Synthetic peptide"
QNVGYN

SEQ ID NO: 1752 - protein, 3 aa, Artificial Sequence
  source: /note="Description of Artificial Sequence: Synthetic peptide"
SAS

SEQ ID NO: 1753 - protein, 9 aa, Artificial Sequence
  source: /note="Description of Artificial Sequence: Synthetic peptide"
QQYNSYPLT

SEQ ID NO: 1754 - protein, 98 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 1755 - protein, 15 aa, Artificial Sequence
  source: /note="Description of Artificial Sequence: Synthetic peptide"
YFDYWGQGTLVTVSS

SEQ ID NO: 1756 - protein, 120 aa, Artificial Sequence; identical to SEQ ID NO: 1578
  source: /note="Description of Artificial Sequence: Synthetic polypeptide"
  VARIANT (33)..(33): /replace="Gln" or "Ser" or "Ala"
  VARIANT (105)..(105): /replace="Gln" or "Ser" or "Ala"
  MISC_FEATURE (1)..(120): /note="Variant residues given in the sequence have no preference with respect to those in the annotations for variant positions"

SEQ ID NO: 1757 - protein, 98 aa, Artificial Sequence; identical to SEQ ID NO: 1754
  source: /note="Description of Artificial Sequence: Synthetic polypeptide"
  VARIANT (33)..(33): /replace="Gln" or "Ser" or "Ala"
  MISC_FEATURE (1)..(98): /note="Variant residues given in the sequence have no preference with respect to those in the annotations for variant positions"

SEQ ID NO: 1758 - protein, 120 aa, Artificial Sequence; identical to SEQ ID NO: 1019
  source: /note="Description of Artificial Sequence: Synthetic polypeptide"
  VARIANT (33)..(33): /replace="Gln" or "Ser" or "Ala"
  VARIANT (105)..(105): /replace="Gln" or "Ser" or "Ala"
  MISC_FEATURE (1)..(120): /note="Variant residues given in the sequence have no preference with respect to those in the annotations for variant positions"

SEQ ID NO: 1759 - protein, 120 aa, Artificial Sequence
  source: /note="Description of Artificial Sequence: Synthetic polypeptide"
  VARIANT (33)..(33): /replace="Gln" or "Ser" or "Ala"
  VARIANT (105)..(105): /replace="Gln" or "Ser" or "Ala"
  MISC_FEATURE (1)..(120): /note="Variant residues given in the sequence have no preference with respect to those in the annotations for variant positions"
QVQLVQSGAEVKKPGASVKVSCKASGYTFTDYNINWVRQAPGQGLEWIGYIYPYIGGSGYAQKFQGRVTMTADTSTSTVYMELSSLRSEDTAVYYCAREDKTARNAMDYWGQGTLVTVSS

SEQ ID NO: 1760 - protein, 120 aa, Artificial Sequence
  source: /note="Description of Artificial Sequence: Synthetic polypeptide"
  VARIANT (33)..(33): /replace="Gln" or "Ser" or "Ala"
  VARIANT (105)..(105): /replace="Gln" or "Ser" or "Ala"
  MISC_FEATURE (1)..(120): /note="Variant residues given in the sequence have no preference with respect to those in the annotations for variant positions"
QVQLVQSGAEVKKPGASVKISCKASGYTFTDYNINWVRQAPGQGLEWIGYIYPYIGGSGYAQKFQGRATLTADTSTSTAYMELSSLRSEDTAVYYCAREDKTARNAMDYWGQGTLVTVSS

SEQ ID NO: 1761 - protein, 120 aa, Artificial Sequence
  source: /note="Description of Artificial Sequence: Synthetic polypeptide"
  VARIANT (33)..(33): /replace="Gln" or "Ser" or "Ala"
  VARIANT (105)..(105): /replace="Gln" or "Ser" or "Ala"
  MISC_FEATURE (1)..(120): /note="Variant residues given in the sequence have no preference with respect to those in the annotations for variant positions"
QVQLVQSGAEVKKPGASVKISCKASGYTFTDYNINWVRQAPGQGLEWIGYIYPYIGGSGYAQKFQGRATLTADNSTSTAYMELSSLRSEDTAVYYCAREDKTARNAMDYWGQGTLVTVSS

SEQ ID NO: 1762 - protein, 96 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPP

SEQ ID NO: 1763 - protein, 12 aa, Artificial Sequence
  source: /note="Description of Artificial Sequence: Synthetic peptide"
YTFGQGTKLEIK

SEQ ID NO: 1764 - protein, 107 aa, Artificial Sequence; identical to SEQ ID NO: 1582
  source: /note="Description of Artificial Sequence: Synthetic polypeptide"
  VARIANT (28)..(28): /replace="Gln" or "Ser" or "Ala" or "Asp"
  VARIANT (32)..(32): /replace="Gln" or "Ser" or "Ala" or "Asp"
  VARIANT (53)..(53): /replace="Gln" or "Ser" or "Ala" or "Asp"
  VARIANT (92)..(92): /replace="Tyr" or "Phe" or "His"
  MISC_FEATURE (1)..(107): /note="Variant residues given in the sequence have no preference with respect to those in the annotations for variant positions"

SEQ ID NO: 1765 - protein, 96 aa, Artificial Sequence
  source: /note="Description of Artificial Sequence: Synthetic polypeptide"
  VARIANT (28)..(28): /replace="Ser" or "Ala" or "Asp"
  VARIANT (32)..(32): /replace="Gln" or "Ser" or "Ala" or "Asp"
  VARIANT (53)..(53): /replace="Ser" or "Ala" or "Asp"
  VARIANT (92)..(92): /replace="Phe" or "His"
  MISC_FEATURE (1)..(96): /note="Variant residues given in the sequence have no preference with respect to those in the annotations for variant positions"
DIQMTQSPSSLSASVGDRVTITCRASQQISSYLNWYQQKPGKAPKLLIYAASQLQSGVPSRFSGSGSGTDFTLTISSLQPEDFATYYCQQSYSTPP

SEQ ID NO: 1766 - protein, 107 aa, Artificial Sequence; identical to SEQ ID NO: 1024
  source: /note="Description of Artificial Sequence: Synthetic polypeptide"
  VARIANT (28)..(28): /replace="Gln" or "Ser" or "Ala" or "Asp"
  VARIANT (32)..(32): /replace="Gln" or "Ser" or "Ala" or "Asp"
  VARIANT (53)..(53): /replace="Gln" or "Ser" or "Ala" or "Asp"
  VARIANT (92)..(92): /replace="Tyr" or "Phe" or "His"
  MISC_FEATURE (1)..(107): /note="Variant residues given in the sequence have no preference with respect to those in the annotations for variant positions"

SEQ ID NO: 1767 - protein, 107 aa, Artificial Sequence
  source: /note="Description of Artificial Sequence: Synthetic polypeptide"
  VARIANT (28)..(28): /replace="Gln" or "Ser" or "Ala" or "Asp"
  VARIANT (32)..(32): /replace="Gln" or "Ser" or "Ala" or "Asp"
  VARIANT (53)..(53): /replace="Gln" or "Ser" or "Ala" or "Asp"
  VARIANT (92)..(92): /replace="Tyr" or "Phe" or "His"
  MISC_FEATURE (1)..(107): /note="Variant residues given in the sequence have no preference with respect to those in the annotations for variant positions"
DIQMTQSPSSLSASVGDRVTITCRVSENIYSNLAWYQQKPGKAPKLLIYEATNLAEGVPSRFSGSGSGTDYTLTISSLQPEDFATYYCQHFWGTPYTFGQGTKLEIK

SEQ ID NO: 1768 - protein, 107 aa, Artificial Sequence
  source: /note="Description of Artificial Sequence: Synthetic polypeptide"
  VARIANT (28)..(28): /replace="Gln" or "Ser" or "Ala" or "Asp"
  VARIANT (32)..(32): /replace="Gln" or "Ser" or "Ala" or "Asp"
  VARIANT (53)..(53): /replace="Gln" or "Ser" or "Ala" or "Asp"
  VARIANT (92)..(92): /replace="Tyr" or "Phe" or "His"
  MISC_FEATURE (1)..(107): /note="Variant residues given in the sequence have no preference with respect to those in the annotations for variant positions"
DIQMTQSPSSLSASVGDRVTITCRVSENIYSNLAWYQQKPGKAPKLLVYEATNLAEGVPSRFSGSGSGTDYTLTISSLQPEDFGTYYCQHFWGTPYTFGQGTKLEIK

SEQ ID NO: 1769 - protein, 98 aa, Artificial Sequence; identical to SEQ ID NO: 1754
  source: /note="Description of Artificial Sequence: Synthetic polypeptide"

SEQ ID NO: 1770 - protein, 15 aa, Artificial Sequence
  source: /note="Description of Artificial Sequence: Synthetic peptide"
YFDYWGQGTLVTVSS

SEQ ID NO: 1771 - protein, 119 aa, Artificial Sequence; identical to SEQ ID NO: 1674
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"

SEQ ID NO: 1772 - protein, 98 aa, Artificial Sequence
  source: /note="Description of Artificial Sequence: Synthetic polypeptide"
  VARIANT (31)..(31): /replace="Ser" or "Ala"
  VARIANT (52)..(52): /replace="Gln" or "Ser" or "Ala"
  MISC_FEATURE (1)..(98): /note="Variant residues given in the sequence have no preference with respect to those in the annotations for variant positions"
QVQLVQSGAEVKKPGASVKVSCKASGYTFTQYYMHWVRQAPGQGLEWMGIINPSGGSTSYAQKFQGRVTMTRDTSTSTVYMELSSLRSEDTAVYYCAR

SEQ ID NO: 1773 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKASGYAFTNYLIEWVRQAPGQGLEWMGVINPGSGGIYYAQKFQGRVTMTRDTSTSTVYMELSSLRSEDTAVYYCARSETHDTWFAYWGQGTLVTVSS

SEQ ID NO: 1774 - protein, 119 aa, Artificial Sequence; identical to SEQ ID NO: 1029
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"

SEQ ID NO: 1775 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKTSGYAFTNYLIEWVRQAPGQGLEWIGVINPGSGGIYYAQKFQGRVTLTADTSTSTAYMELSSLRSEDTAVYYCARSETHDTWFAYWGQGTLVTVSS

SEQ ID NO: 1776 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKTSGYAFTNYLIEWVRQAPGQGLEWIGVINPGSGGIYYAQKFQGRVTLTADKSTSTAYMELSSLRSEDTAVYYCARSETHDTWFAYWGQGTLVTVSS

SEQ ID NO: 1777 - protein, 96 aa, Artificial Sequence; identical to SEQ ID NO: 1762
  source: /note="Description of Artificial Sequence: Synthetic polypeptide"

SEQ ID NO: 1778 - protein, 12 aa, Artificial Sequence
  source: /note="Description of Artificial Sequence: Synthetic peptide"
YTFGQGTKLEIK

SEQ ID NO: 1779 - protein, 96 aa, Artificial Sequence
  source: /note="Description of Artificial Sequence: Synthetic polypeptide"
DIQMTQSPSSLSASVGDRVTITCRASQGIRNDLGWYQQKPGKAPKRLIYAASSLQSGVPSRFSGSGSGTEFTLTISNLQPEDFATYYCLQHNSYPP

SEQ ID NO: 1780 - protein, 107 aa, Artificial Sequence
  source: /note="Description of Artificial Sequence: Synthetic polypeptide"
  VARIANT (92)..(92): /replace="Tyr" or "Phe" or "His"
  VARIANT (93)..(93): /replace="Gln" or "Ser" or "Ala" or "Asp"
  MISC_FEATURE (1)..(107): /note="Variant residues given in the sequence have no preference with respect to those in the annotations for variant positions"
DIVMTQSQKFISTSVGDRVSITCKASQSVRIAVAWFQQKPGQSPKALIYLASTRHTGVPDRFTGSGSGTDFTLTISNVQSEDLADYFCLQHWNYPYTFGGGTKLEIK

SEQ ID NO: 1781 - protein, 96 aa, Artificial Sequence
  source: /note="Description of Artificial Sequence: Synthetic polypeptide"
  VARIANT (92)..(92): /replace="Phe" or "His"
  VARIANT (93)..(93): /replace="Ser" or "Ala" or "Asp"
  MISC_FEATURE (1)..(96): /note="Variant residues given in the sequence have no preference with respect to those in the annotations for variant positions"
DIQMTQSPSSLSASVGDRVTITCRASQSISSYLNWYQQKPGKAPKLLIYAASSLQSGVPSRFSGSGSGTDFTLTISSLQPEDFATYYCQQSYQTPP

SEQ ID NO: 1782 - protein, 107 aa, Artificial Sequence
  source: /note="Description of Artificial Sequence: Synthetic polypeptide"
  VARIANT (92)..(92): /replace="Tyr" or "Phe" or "His"
  VARIANT (93)..(93): /replace="Gln" or "Ser" or "Ala" or "Asp"
  MISC_FEATURE (1)..(107): /note="Variant residues given in the sequence have no preference with respect to those in the annotations for variant positions"
DIQMTQSPSSLSASVGDRVTITCKASQSVRIAVAWYQQKPGKAPKLLIYLASTRHTGVPSRFSGSGSGTDFTLTISSLQPEDFATYYCLQHWNYPYTFGQGTKLEIK

SEQ ID NO: 1783 - protein, 107 aa, Artificial Sequence; identical to SEQ ID NO: 1034
  source: /note="Description of Artificial Sequence: Synthetic polypeptide"
  VARIANT (92)..(92): /replace="Tyr" or "Phe" or "His"
  VARIANT (93)..(93): /replace="Gln" or "Ser" or "Ala" or "Asp"
  MISC_FEATURE (1)..(107): /note="Variant residues given in the sequence have no preference with respect to those in the annotations for variant positions"

SEQ ID NO: 1784 - protein, 98 aa, Artificial Sequence; identical to SEQ ID NO: 1754
  source: /note="Description of Artificial Sequence: Synthetic polypeptide"

SEQ ID NO: 1785 - protein, 15 aa, Artificial Sequence
  source: /note="Description of Artificial Sequence: Synthetic peptide"
YFDYWGQGTLVTVSS

SEQ ID NO: 1786 - protein, 120 aa, Artificial Sequence; identical to SEQ ID NO: 1682
  source: /note="Description of Artificial Sequence: Synthetic polypeptide"
  VARIANT (31)..(31): /replace="Gln" or "Ser" or "Ala"
  VARIANT (33)..(33): /replace="Tyr" or "Phe" or "His"
  VARIANT (59)..(59): /replace="Gln" or "Ser" or "Ala"
  MISC_FEATURE (1)..(120): /note="Variant residues given in the sequence have no preference with respect to those in the annotations for variant positions"

SEQ ID NO: 1787 - protein, 98 aa, Artificial Sequence
  source: /note="Description of Artificial Sequence: Synthetic polypeptide"
  VARIANT (31)..(31): /replace="Ser" or "Ala"
  VARIANT (33)..(33): /replace="Phe" or "His"
  VARIANT (59)..(59): /replace="Ser" or "Ala"
  MISC_FEATURE (1)..(98): /note="Variant residues given in the sequence have no preference with respect to those in the annotations for variant positions"
QVQLVQSGAEVKKPGASVKVSCKASGYTFTQYYMHWVRQAPGQGLEWMGIINPSGGSTQYAQKFQGRVTMTRDTSTSTVYMELSSLRSEDTAVYYCAR

SEQ ID NO: 1788 - protein, 120 aa, Artificial Sequence
  source: /note="Description of Artificial Sequence: Synthetic polypeptide"
  VARIANT (31)..(31): /replace="Gln" or "Ser" or "Ala"
  VARIANT (33)..(33): /replace="Tyr" or "Phe" or "His"
  VARIANT (59)..(59): /replace="Gln" or "Ser" or "Ala"
  MISC_FEATURE (1)..(120): /note="Variant residues given in the sequence have no preference with respect to those in the annotations for variant positions"
QVQLVQSGAEVKKPGASVKVSCKASGYTFTNYWIGWVRQAPGQGLEWMGDIYPGGGYTNYAQKFQGRVTMTRDTSTSTVYMELSSLRSEDTAVYYCARPYYGSSYGFAFWGQGTLVTVSS

SEQ ID NO: 1789 - protein, 120 aa, Artificial Sequence
  source: /note="Description of Artificial Sequence: Synthetic polypeptide"
  VARIANT (31)..(31): /replace="Gln" or "Ser" or "Ala"
  VARIANT (33)..(33): /replace="Tyr" or "Phe" or "His"
  VARIANT (59)..(59): /replace="Gln" or "Ser" or "Ala"
  MISC_FEATURE (1)..(120): /note="Variant residues given in the sequence have no preference with respect to those in the annotations for variant positions"
QVQLVQSGAEVKKPGASVKVSCKASGYTFTNYWIGWVRQAPGQGLEWIGDIYPGGGYTNYAQKFQGRVTMTADTSTSTVYMELSSLRSEDTAVYYCASPYYGSSYGFAFWGQGTLVTVSS

SEQ ID NO: 1790 - protein, 120 aa, Artificial Sequence
  source: /note="Description of Artificial Sequence: Synthetic polypeptide"
  VARIANT (31)..(31): /replace="Gln" or "Ser" or "Ala"
  VARIANT (33)..(33): /replace="Tyr" or "Phe" or "His"
  VARIANT (59)..(59): /replace="Gln" or "Ser" or "Ala"
  MISC_FEATURE (1)..(120): /note="Variant residues given in the sequence have no preference with respect to those in the annotations for variant positions"
QVQLVQSGAEVKKPGASVKMSCKASGYTFTNYWIGWVRQAPGQGLEWIGDIYPGGGYTNYAQKFQGRATLTADTSTSTAYMELSSLRSEDTAVYYCASPYYGSSYGFAFWGQGTLVTVSS

SEQ ID NO: 1791 - protein, 98 aa, Artificial Sequence; identical to SEQ ID NO: 1754
  source: /note="Description of Artificial Sequence: Synthetic polypeptide"

SEQ ID NO: 1792 - protein, 15 aa, Artificial Sequence
  source: /note="Description of Artificial Sequence: Synthetic peptide"
YFDYWGQGTLVTVSS

SEQ ID NO: 1793 - protein, 118 aa, Artificial Sequence; identical to SEQ ID NO: 1610
  source: /note="Description of Artificial Sequence: Synthetic polypeptide"
  VARIANT (57)..(57): /replace="Gln" or "Ser" or "Ala"
  VARIANT (59)..(59): /replace="Gln" or "Ser" or "Ala"
  VARIANT (104)..(104): /replace="Leu" or "Phe" or "Ala"
  MISC_FEATURE (1)..(118): /note="Variant residues given in the sequence have no preference with respect to those in the annotations for variant positions"

SEQ ID NO: 1794 - protein, 98 aa, Artificial Sequence; identical to SEQ ID NO: 1754
  source: /note="Description of Artificial Sequence: Synthetic polypeptide"
  VARIANT (57)..(57): /replace="Gln" or "Ala"
  VARIANT (59)..(59): /replace="Gln" or "Ala"
  MISC_FEATURE (1)..(98): /note="Variant residues given in the sequence have no preference with respect to those in the annotations for variant positions"

SEQ ID NO: 1795 - protein, 118 aa, Artificial Sequence
  source: /note="Description of Artificial Sequence: Synthetic polypeptide"
  VARIANT (57)..(57): /replace="Gln" or "Ser" or "Ala"
  VARIANT (59)..(59): /replace="Gln" or "Ser" or "Ala"
  VARIANT (104)..(104): /replace="Leu" or "Phe" or "Ala"
  MISC_FEATURE (1)..(118): /note="Variant residues given in the sequence have no preference with respect to those in the annotations for variant positions"
QVQLVQSGAEVKKPGASVKVSCKASGYKFPDYVMHWVRQAPGQGLEWMGIISIYSGNTNYAQKFQGRVTMTRDTSTSTVYMELSSLRSEDTAVYYCAREGDLPMFAYWGQGTLVTVSS

SEQ ID NO: 1796 - protein, 118 aa, Artificial Sequence
  source: /note="Description of Artificial Sequence: Synthetic polypeptide"
  VARIANT (57)..(57): /replace="Gln" or "Ser" or "Ala"
  VARIANT (59)..(59): /replace="Gln" or "Ser" or "Ala"
  VARIANT (104)..(104): /replace="Leu" or "Phe" or "Ala"
  MISC_FEATURE (1)..(118): /note="Variant residues given in the sequence have no preference with respect to those in the annotations for variant positions"
QVQLVQSGAEVKKPGASVKVSCKASGYKFPDYVMHWVRQAPGQGLEWIGIISIYSGNTNYAQKFQGRVTMTVDTSTSTVYMELSSLRSEDTAVYYCAREGDLPMFAYWGQGTLVTVSS

SEQ ID NO: 1797 - protein, 118 aa, Artificial Sequence
  source: /note="Description of Artificial Sequence: Synthetic polypeptide"
  VARIANT (57)..(57): /replace="Gln" or "Ser" or "Ala"
  VARIANT (59)..(59): /replace="Gln" or "Ser" or "Ala"
  VARIANT (104)..(104): /replace="Leu" or "Phe" or "Ala"
  MISC_FEATURE (1)..(118): /note="Variant residues given in the sequence have no preference with respect to those in the annotations for variant positions"
QVQLVQSGAEVKKPGASVKISCKGSGYKFPDYVMHWVRQAPGQGLEWIGIISIYSGNTNYAQKFQGRATMTVDTSTSTAYMELSSLRSEDTAVYYCAREGDLPMFAYWGQGTLVTVSS

SEQ ID NO: 1798 - protein, 118 aa, Artificial Sequence
  source: /note="Description of Artificial Sequence: Synthetic polypeptide"
  VARIANT (57)..(57): /replace="Gln" or "Ser" or "Ala"
  VARIANT (59)..(59): /replace="Gln" or "Ser" or "Ala"
  VARIANT (104)..(104): /replace="Leu" or "Phe" or "Ala"
  MISC_FEATURE (1)..(118): /note="Variant residues given in the sequence have no preference with respect to those in the annotations for variant positions"
QVQLVQSGAEVKKPGASVKISCKGSGYKFPDYVMHWVRQAPGQGLEWIGIISIYSGNTNYAQKFQGRATMTVDKSTSTAYMELSSLRSEDTAVYYCAREGDLPMFAYWGQGTLVTVSS

SEQ ID NO: 1799 - protein, 96 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPP

SEQ ID NO: 1800 - protein, 12 aa, Artificial Sequence
  source: /note="Description of Artificial Sequence: Synthetic peptide"
YTFGQGTKLEIK

SEQ ID NO: 1801 - protein, 106 aa, Artificial Sequence; identical to SEQ ID NO: 1614
  source: /note="Description of Artificial Sequence: Synthetic polypeptide"
  VARIANT (24)..(24): /replace="Gln" or "Ser" or "Ala" or "Asp"
  VARIANT (52)..(52): /replace="Gln" or "Ser" or "Ala" or "Asp"
  VARIANT (90)..(90): /replace="Tyr" or "Phe" or "His"
  MISC_FEATURE (1)..(106): /note="Variant residues given in the sequence have no preference with respect to those in the annotations for variant positions"

SEQ ID NO: 1802 - protein, 96 aa, Artificial Sequence; identical to SEQ ID NO: 1799
  source: /note="Description of Artificial Sequence: Synthetic polypeptide"
  VARIANT (24)..(24): /replace="Gln" or "Ser" or "Ala" or "Asp"
  VARIANT (53)..(53): /replace="Gln" or "Ser" or "Ala" or "Asp"
  VARIANT (91)..(91): /replace="Tyr" or "Phe" or "His"
  MISC_FEATURE (1)..(96): /note="Variant residues given in the sequence have no preference with respect to those in the annotations for variant positions"

SEQ ID NO: 1803 - protein, 106 aa, Artificial Sequence
  source: /note="Description of Artificial Sequence: Synthetic polypeptide"
  VARIANT (24)..(24): /replace="Gln" or "Ser" or "Ala" or "Asp"
  VARIANT (52)..(52): /replace="Gln" or "Ser" or "Ala" or "Asp"
  VARIANT (90)..(90): /replace="Tyr" or "Phe" or "His"
  MISC_FEATURE (1)..(106): /note="Variant residues given in the sequence have no preference with respect to those in the annotations for variant positions"
EIVLTQSPATLSLSPGERATLSCNASSSVSYMYWYQQKPGQAPRLLIYDTSNLASGIPARFSGSGSGTDFTLTISSLEPEDFAVYYCQQWSSYPLTFGQGTKLEIK

SEQ ID NO: 1804 - protein, 106 aa, Artificial Sequence
  source: /note="Description of Artificial Sequence: Synthetic polypeptide"
  VARIANT (24)..(24): /replace="Gln" or "Ser" or "Ala" or "Asp"
  VARIANT (52)..(52): /replace="Gln" or "Ser" or "Ala" or "Asp"
  VARIANT (90)..(90): /replace="Tyr" or "Phe" or "His"
  MISC_FEATURE (1)..(106): /note="Variant residues given in the sequence have no preference with respect to those in the annotations for variant positions"
EIVLTQSPATLSLSPGERATLSCNASSSVSYMYWYQQKPGQAPRLLIYDTSNLASGIPARFSGSGSGTDYTLTISSLEPEDFAVYYCQQWSSYPLTFGQGTKLEIK

SEQ ID NO: 1805 - protein, 106 aa, Artificial Sequence
  source: /note="Description of Artificial Sequence: Synthetic polypeptide"
  VARIANT (24)..(24): /replace="Gln" or "Ser" or "Ala" or "Asp"
  VARIANT (52)..(52): /replace="Gln" or "Ser" or "Ala" or "Asp"
  VARIANT (90)..(90): /replace="Tyr" or "Phe" or "His"
  MISC_FEATURE (1)..(106): /note="Variant residues given in the sequence have no preference with respect to those in the annotations for variant positions"
EIVLTQSPATLSLSPGERVTMSCNASSSVSYMYWYQQKPGQAPRLLIYDTSNLASGVPARFSGSGSGTDYTLTISSMEPEDFAVYYCQQWSSYPLTFGQGTKVEIK

SEQ ID NO: 1806 - protein, 98 aa, Artificial Sequence; identical to SEQ ID NO: 1754
  source: /note="Description of Artificial Sequence: Synthetic polypeptide"

SEQ ID NO: 1807 - protein, 15 aa, Artificial Sequence
  source: /note="Description of Artificial Sequence: Synthetic peptide"
YFDYWGQGTLVTVSS

SEQ ID NO: 1808 - protein, 119 aa, Artificial Sequence; identical to SEQ ID NO: 1642
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (103)..(103): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"

SEQ ID NO: 1809 - protein, 98 aa, Artificial Sequence; identical to SEQ ID NO: 1754
  source: /note="Description of Artificial Sequence: Synthetic polypeptide"
  VARIANT (31)..(31): /replace="Gln" or "Ala"
  VARIANT (52)..(52): /replace="Gln" or "Ser" or "Ala"
  MISC_FEATURE (1)..(98): /note="Variant residues given in the sequence have no preference with respect to those in the annotations for variant positions"

SEQ ID NO: 1810 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (103)..(103): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKASGYAFTNHLIEWVRQAPGQGLEWMGVINPGSDSTDYAQKFQGRVTMTRDTSTSTVYMELSSLRSEDTAVYYCARSLYYNSWFVYWGQGTLVTVSS

SEQ ID NO: 1811 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (103)..(103): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKASGYAFTNHLIEWVRQAPGQGLEWIGVINPGSDSTDYAQKFQGRVTMTADTSTSTVYMELSSLRSEDTAVYYCARSLYYNSWFVYWGQGTLVTVSS

SEQ ID NO: 1812 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (103)..(103): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKASGYAFTNHLIEWIRQAPGQGLEWIGVINPGSDSTDYAQKFQGRATLTADTSTSTAYMELSSLRSEDTAVYYCARSLYYNSWFVYWGQGTLVTVSS

SEQ ID NO: 1813 - protein, 119 aa, Artificial Sequence
  source: /note="Description of Artificial Sequence: Synthetic polypeptide"
  VARIANT (31)..(31): /replace="Gln" or "Ser" or "Ala"
  VARIANT (52)..(52): /replace="Gln" or "Ser" or "Ala"
  VARIANT (103)..(103): /replace="Gln" or "Ser" or "Ala"
  VARIANT (105)..(105): /replace="Tyr" or "Phe" or "His"
  MISC_FEATURE (1)..(119): /note="Variant residues given in the sequence have no preference with respect to those in the annotations for variant positions"
QVQLVQSGAEVKKPGASVKVSCKASGYAFTNHLIEWIRQAPGQGLEWIGVINPGSDSTDYAQKFQGRATLTADKSTSTAYMELSSLRSEDTAVYYCARSLYYNSWFVYWGQGTLVTVSS

SEQ ID NO: 1814 - protein, 96 aa, Artificial Sequence; identical to SEQ ID NO: 1762
  source: /note="Description of Artificial Sequence: Synthetic polypeptide"

SEQ ID NO: 1815 - protein, 12 aa, Artificial Sequence
  source: /note="Description of Artificial Sequence: Synthetic peptide"
YTFGQGTKLEIK

SEQ ID NO: 1816 - protein, 107 aa, Artificial Sequence; identical to SEQ ID NO: 1646
  source: /note="Description of Artificial Sequence: Synthetic polypeptide"
  VARIANT (28)..(28): /replace="Gln" or "Ser" or "Ala" or "Asp"
  VARIANT (50)..(50): /replace="Gln" or "Ser" or "Ala" or "Asp"
  MISC_FEATURE (1)..(107): /note="Variant residues given in the sequence have no preference with respect to those in the annotations for variant positions"

SEQ ID NO: 1817 - protein, 96 aa, Artificial Sequence; identical to SEQ ID NO: 1762
  source: /note="Description of Artificial Sequence: Synthetic polypeptide"
  VARIANT (28)..(28): /replace="Gln" or "Ala" or "Asp"
  VARIANT (50)..(50): /replace="Gln" or "Ser" or "Asp"
  MISC_FEATURE (1)..(96): /note="Variant residues given in the sequence have no preference with respect to those in the annotations for variant positions"

SEQ ID NO: 1818 - protein, 107 aa, Artificial Sequence
  source: /note="Description of Artificial Sequence: Synthetic polypeptide"
  VARIANT (28)..(28): /replace="Gln" or "Ser" or "Ala" or "Asp"
  VARIANT (50)..(50): /replace="Gln" or "Ser" or "Ala" or "Asp"
  MISC_FEATURE (1)..(107): /note="Variant residues given in the sequence have no preference with respect to those in the annotations for variant positions"
DIQMTQSPSSLSASVGDRVTITCRASENIYSYLAWYQQKPGKAPKLLIYNAKTLVEGVPSRFSGSGSGTDFTLTISSLQPEDFATYYCQHHYGTPYTFGQGTKLEIK

SEQ ID NO: 1819 - protein, 107 aa, Artificial Sequence
  source: /note="Description of Artificial Sequence: Synthetic polypeptide"
  VARIANT (28)..(28): /replace="Gln" or "Ser" or "Ala" or "Asp"
  VARIANT (50)..(50): /replace="Gln" or "Ser" or "Ala" or "Asp"
  MISC_FEATURE (1)..(107): /note="Variant residues given in the sequence have no preference with respect to those in the annotations for variant positions"
DIQMTQSPSSLSASVGDRVTITCRASENIYSYLAWYQQKPGKAPKLLVYNAKTLVEGVPSRFSGSGSGTDFTLTISSLQPEDFGTYYCQHHYGTPYTFGQGTKLEIK

SEQ ID NO: 1820 - protein, 120 aa, Artificial Sequence; identical to SEQ ID NO: 1019
  source: /note="Description of Artificial Sequence: Synthetic polypeptide"

SEQ ID NO: 1821 - protein, 120 aa, Artificial Sequence; identical to SEQ ID NO: 1759
  source: /note="Description of Artificial Sequence: Synthetic polypeptide"

SEQ ID NO: 1822 - protein, 120 aa, Artificial Sequence; identical to SEQ ID NO: 1760
  source: /note="Description of Artificial Sequence: Synthetic polypeptide"

SEQ ID NO: 1823 - protein, 120 aa, Artificial Sequence; identical to SEQ ID NO: 1761
  source: /note="Description of Artificial Sequence: Synthetic polypeptide"

SEQ ID NO: 1824 - protein, 107 aa, Artificial Sequence; identical to SEQ ID NO: 1024
  source: /note="Description of Artificial Sequence: Synthetic polypeptide"

SEQ ID NO: 1825 - protein, 107 aa, Artificial Sequence; identical to SEQ ID NO: 1767
  source: /note="Description of Artificial Sequence: Synthetic polypeptide"

SEQ ID NO: 1826 - protein, 107 aa, Artificial Sequence; identical to SEQ ID NO: 1768
  source: /note="Description of Artificial Sequence: Synthetic polypeptide"

SEQ ID NO: 1827 - protein, 119 aa, Artificial Sequence; identical to SEQ ID NO: 1773
  source: /note="Description of Artificial Sequence: Synthetic polypeptide"

SEQ ID NO: 1828 - protein, 119 aa, Artificial Sequence; identical to SEQ ID NO: 1029
  source: /note="Description of Artificial Sequence: Synthetic polypeptide"

SEQ ID NO: 1829 - protein, 119 aa, Artificial Sequence; identical to SEQ ID NO: 1775
  source: /note="Description of Artificial Sequence: Synthetic polypeptide"

SEQ ID NO: 1830 - protein, 119 aa, Artificial Sequence; identical to SEQ ID NO: 1776
  source: /note="Description of Artificial Sequence: Synthetic polypeptide"

SEQ ID NO: 1831 - protein, 107 aa, Artificial Sequence; identical to SEQ ID NO: 1782
  source: /note="Description of Artificial Sequence: Synthetic polypeptide"

SEQ ID NO: 1832 - protein, 107 aa, Artificial Sequence; identical to SEQ ID NO: 1034
  source: /note="Description of Artificial Sequence: Synthetic polypeptide"

SEQ ID NO: 1833 - protein, 120 aa, Artificial Sequence; identical to SEQ ID NO: 1788
  source: /note="Description of Artificial Sequence: Synthetic polypeptide"

SEQ ID NO: 1834 - protein, 120 aa, Artificial Sequence; identical to SEQ ID NO: 1789
  source: /note="Description of Artificial Sequence: Synthetic polypeptide"

SEQ ID NO: 1835 - protein, 120 aa, Artificial Sequence; identical to SEQ ID NO: 1790
  source: /note="Description of Artificial Sequence: Synthetic polypeptide"

SEQ ID NO: 1836 - protein, 107 aa, Artificial Sequence; identical to SEQ ID NO: 1782
  source: /note="Description of Artificial Sequence: Synthetic polypeptide"

SEQ ID NO: 1837 - protein, 107 aa, Artificial Sequence; identical to SEQ ID NO: 1034
  source: /note="Description of Artificial Sequence: Synthetic polypeptide"

SEQ ID NO: 1838 - protein, 118 aa, Artificial Sequence; identical to SEQ ID NO: 1795
  source: /note="Description of Artificial Sequence: Synthetic polypeptide"

SEQ ID NO: 1839 - protein, 118 aa, Artificial Sequence; identical to SEQ ID NO: 1796
  source: /note="Description of Artificial Sequence: Synthetic polypeptide"

SEQ ID NO: 1840 - protein, 118 aa, Artificial Sequence; identical to SEQ ID NO: 1797
  source: /note="Description of Artificial Sequence: Synthetic polypeptide"

SEQ ID NO: 1841 - protein, 118 aa, Artificial Sequence; identical to SEQ ID NO: 1798
  source: /note="Description of Artificial Sequence: Synthetic polypeptide"

SEQ ID NO: 1842 - protein, 106 aa, Artificial Sequence; identical to SEQ ID NO: 1803
  source: /note="Description of Artificial Sequence: Synthetic polypeptide"

SEQ ID NO: 1843 - protein, 106 aa, Artificial Sequence; identical to SEQ ID NO: 1804
  source: /note="Description of Artificial Sequence: Synthetic polypeptide"

SEQ ID NO: 1844 - protein, 106 aa, Artificial Sequence; identical to SEQ ID NO: 1805
  source: /note="Description of Artificial Sequence: Synthetic polypeptide"

SEQ ID NO: 1845 - protein, 119 aa, Artificial Sequence; identical to SEQ ID NO: 1810
  source: /note="Description of Artificial Sequence: Synthetic polypeptide"

SEQ ID NO: 1846 - protein, 119 aa, Artificial Sequence; identical to SEQ ID NO: 1811
  source: /note="Description of Artificial Sequence: Synthetic polypeptide"

SEQ ID NO: 1847 - protein, 119 aa, Artificial Sequence; identical to SEQ ID NO: 1812
  source: /note="Description of Artificial Sequence: Synthetic polypeptide"

SEQ ID NO: 1848 - protein, 119 aa, Artificial Sequence; identical to SEQ ID NO: 1813
  source: /note="Description of Artificial Sequence: Synthetic polypeptide"

SEQ ID NO: 1849 - protein, 107 aa, Artificial Sequence; identical to SEQ ID NO: 1818
  source: /note="Description of Artificial Sequence: Synthetic polypeptide"

SEQ ID NO: 1850 - protein, 107 aa, Artificial Sequence; identical to SEQ ID NO: 1819
  source: /note="Description of Artificial Sequence: Synthetic polypeptide"

SEQ ID NO: 1851 - protein, 5 aa, Artificial Sequence
  source: /note="Description of Artificial Sequence: Synthetic peptide"
GSGGS

SEQ ID NO: 1852 - protein, 5 aa, Artificial Sequence
  source: /note="Description of Artificial Sequence: Synthetic peptide"
GGGGS

SEQ ID NO: 1853 - protein, 4 aa, Artificial Sequence
  source: /note="Description of Artificial Sequence: Synthetic peptide"
GGGS

SEQ ID NO: 1854 - protein, 15 aa, Artificial Sequence
  source: /note="Description of Artificial Sequence: Synthetic peptide"
GGGGSGGGGSGGGGS

SEQ ID NO: 1855 - protein, 9 aa, Artificial Sequence
  source: /note="Description of Artificial Sequence: Synthetic peptide"
NLVPMVATV

What is claimed is:

1. A method of treatment for cancer in a patient comprising administering the triple combination comprising an anti-TIGIT antibody, an anti-PVRIG antibody and an anti-PD-1 antibody, wherein said anti-PVRIG antibody is an antibody chosen from at least one of CHA.7.518.1.H4 (S241P) and CHA.7.538.1.2.H4(S241P).

2. The method of treatment according to claim 1, wherein said anti-TIGIT antibody is an antibody chosen from at least one of CPA.9.083.H4(S241P), CPA.9.086.H4(S241P), CHA.9.547.7.H4(S241P), and CHA.9.547.13.H4(S241P).

3. The method of treatment according to claim 1, wherein said anti-PD-1 antibody is an antibody chosen from at least one of pembrolizumab and nivolumab.

4. The method of treatment according to claim 1, wherein said triple combination therapy is chosen from the administration of CPA.9.083.H4(S241P), pembrolizumab and CHA.7.518.1.H4(S241P); CPA.9.086.H4(S241P), pembrolizumab and CHA.7.518.1.H4(S241P); CHA.9.547.7.H4 (S241P), pembrolizumab and CHA.7.518.1.H4(S241P); CHA.9.547.13.H4(S241P), pembrolizumab and CHA.7.518.1.H4(S241P); CPA.9.083.H4(S241P), pembrolizumab and CHA.7.538.1.2.H4(S241P); CPA.9.086.H4 (S241P), pembrolizumab and CHA.7.538.1.2.H4(S241P); CHA.9.547.7.H4(S241P), pembrolizumab and CHA.7.538.1.2.H4(S241P); CHA.9.547.13.H4(S241P), pembrolizumab and CHA.7.538.1.2.H4(S241P); CPA.9.083.H4(S241P), nivolumab and CHA.7.518.1.H4 (S241P); CPA.9.086.H4(S241P), nivolumab and CHA.7.518.1.H4(S241P); CHA.9.547.7.H4(S241P), nivolumab and CHA.7.518.1.H4(S241P); CHA.9.547.13.H4(S241P), nivolumab and CHA.7.518.1.H4(S241P); CPA.9.083.H4(S241P), nivolumab and CHA.7.538.1.2.H4(S241P); CPA.9.086.H4 (S241P), nivolumab and CHA.7.538.1.2.H4(S241P); CHA.9.547.7.H4(S241P, nivolumab and CHA.7.538.1.2.H4 (S241P); and CHA.9.547.13.H4(S241P), nivolumab and CHA.7.538.1.2.H4(S241P).

5. The method of treatment according to claim 1, wherein said antibodies are administered simultaneously.

6. The method of treatment according to claim 5, wherein said antibodies are administered as separate infusions or as one infusion of a mixture of the antibodies.

7. The method of treatment according to claim 1, wherein said antibodies are administered sequentially.

8. The method of treatment according to claim 7, wherein the antibodies are administered sequentially over a period of hours or days.

9. The method of treatment according to claim 1, wherein said cancer is selected from the group consisting of prostate cancer, liver cancer (HCC), colorectal cancer, ovarian cancer, endometrial cancer, breast cancer, triple negative breast cancer, pancreatic cancer, stomach (gastric) cancer, cervical cancer, head and neck cancer, thyroid cancer, testis cancer, urothelial cancer, lung cancer (small cell lung, non-small cell lung), melanoma, non melanoma skin cancer (squamous and basal cell carcinoma), glioma, renal cancer (RCC), lymphoma (NHL or HL), Acute myeloid leukemia (AML), T cell Acute Lymphoblastic Leukemia (T-ALL), Diffuse Large B cell lymphoma, testicular germ cell tumors, mesothelioma, esophageal cancer, Merkel Cells cancer, MSI-high cancer, KRAS mutant tumors, adult T-cell leukemia/lymphoma, and Myelodysplastic syndromes (MDS).

10. The method of treatment according to claim 1, wherein said cancer is selected from the group consisting of ovarian cancer, triple negative breast cancer, stomach (gastric) cancer, lung cancer (small cell lung, non-small cell lung), Merkel Cells cancer, MSI-high cancer, KRAS mutant tumors, adult T-cell leukemia/lymphoma, and Myelodysplastic syndromes (MDS).

11. The method of treatment according to claim 1, wherein the antibodies are provided in an administration kit with dosage units of each antibody, either packaged separately in individual dosage units, or together, as a mixture of antibodies as a single dosage unit.

* * * * *